United States Patent 12,569,549 (FLAVIVIRUS VACCINE) - sequence listing, part 24

SEQ ID NO: 10328 - RNA, 9873 nt, synthetic construct
  misc_feature 1..9873: note = derived and/or modified CDS sequence (opt1) from DENV-3__FJ461338__SS-prME
  source 1..9873: mol_type = other RNA
accagcctgtgcctcatgatgatgctgcccgcgaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtgacgtacaagtgccccctggtggccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcggcaggtcgagaaggtggagacgtgggccctccgccacccggggttcaccatcctggcgctgttcctcgcccactacatcggcacctccctgacccagaaggtggtcatcttcatcctgctcatgctggtgacgcccagcatgaccatgcggtgcgtgggggtcggcaaccgcgacttcgtggagggcctgtccggggccacctgggtggacgtcgtgctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtctgcaagcacacctacgtggaccgggggtggggcaacgggtgcggcctgttcgggaagggctccctggtgacctgcgccaagttccagtgcctcgagcccatcgagggcaaggtcgtgcagtacgagaacctgaagtacaccgtgatcatcacggtccacaccggggaccagcaccaggtgggcaacgacacccagggggtcaccgtggagatcacgccccaggccagcaccgtggaggccgtcctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaacaagaaggagctgctggtgaccttcaagaacgcccacgccaagaagcaggaggtcgtggtgctcgggtcccaggagggcgccatgcacaccgcgctgaccggggccacggagatccagaacagcggcgggacctccatcttcgccggccacctgaagtgccgcctcaagatggacaagctggagctgaagggcatgagctacgccatgtgcctcaacaccttcgtcctgaagaaggaggtgtccgagacccagcacgggacgatcctgatcaaggtggagtacaagggcgaggacgccccgtgcaagatccccttcagcaccgaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaaggccctcaagatcaactggtacaagaagggctccagcatcgggaagatgttcgaggcgacggcccgcggcgcccggcgcatggccatcctgggcgacaccgcctgggacttcgggtccgtgggcggggtgctgaacagcctcggcaagatggtccaccagatcttcgggtccgcgtacaccgccctgttcagcggcgtgtcctggatcatgaagatcggcatcggggtgctgctcacctggatcggcctgaacagcaagaacacgtccatgagcttctcctgcatcgtcatcgggatcatcaccctgtacctcggcgccgtggtgcaggccgacatggggtgcgccatcaactggaagggcaaggagctgaagtgcggcagcgggatcttcgtcaccaacgaggtgcacacctggacggagcagtacaagttccaggcggactcccccaagcggctggccaccgccatcgccggcgcctgggagaacggggtgtgcggcatccgcagcaccacccgcatggagaacctcctgtggaagcagatcgcgaacgagctgaactacatcctctgggagaacaacatcaagctgacggtcgtggtgggggacatcatcggcgtcctggagcagggcaagcggaccctcacgccccagccgatggagctgaagtactcctggaagacctgggggaaggccaagatcgtgacggccgagacccagaacagctccttcatcatcgacggccccaacacccccgagtgccccagcgcctcccgcgcgtggaacgtgtgggaggtcgaggactacgggttcggcgtgttcaccacgaacatctggctgaagctccgggaggtgtacacccagagctgcgaccaccgcctgatgagcgccgccatcaaggacgagcgggccgtccacgccgacatgggctactggatcgagtcccagaagaacgggagctggaagctggagaaggcgtccttcatcgaggtgaagacctgcacctggcccaagagccacaccctctggtccaacggcgtgctggagagcgacatgatcatccccaagtccctggccgggcccatcagccagcacaaccaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgctgttcaccttcgtcctcctgctgtccggccagatcacgtggcgggacatggcccacaccctcatcatgatcggcagcaacgcctccgaccgcatggggatgggcgtgacctacctggccctgatcgccaccttcaagatccagcccttcctcgcgctggggttcttcctgcggaagctcacgagccgcgagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgctccaacacgatcttcaccctgaccgtggcctggcggaccgccacgctcatcctggccggggtcagcctgctcccgctgtgccagtccagctccatgcgcaagaccgactggctgcccatgaccgtggcggccatgggcgtgccgcccctgccgctgttcatcttcagcctgaaggacacccccaagcggcgctcctggcccctcaacgagggggtcatggccgtgggcctggtgagcatcctggcctccagcctcctgcgcaacgacgtccccatggccggcccgctggtggccggcgggctcctgatcgcctgctacgtgatcacggggacctccgccgacctgaccgtcgagaaggccgccgacgtgacctgggaggaggaggcggagcagacgggggtgagccacaacctcatgatcaccgtcgacgacgacgggaccatgcggatcaaggacgacgagaccgagaacatcctgaccgtgctgctcaagacggccctgctgatcgtgtccggcatcttcccctacagcatccccgccaccctcctggtctggcacacctggcagaagcagacccagcgctccggcgtgctgtgggacgtgcccagcccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggcgtccgtgaagaaggacctcatcagctacggcgggggctggcgcctgtccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtcgggctgtacggcaacggggtggtgaccaagaacggcgggtacgtctccggcatcgcccagaccaacgccgagcccgacggccccacgcccgagctcgaggaggagatgttcaagaagcgcaacctgaccatcatggacctgcacccggggagcggcaagacccggaagtacctccccgccatcgtgcgcgaggccatcaagcggcgcctgcggaccctgatcctcgcgcccacgcgcgtggtcgccgccgagatggaggaggccctgaaggggctgcccatccggtaccagaccaccgccaccaagtccgagcacacgggccgcgagatcgtggacctcatgtgccacgcgaccttcaccatgcggctgctgagcccggtgcgcgtccccaactacaacctcatcatcatggacgaggcccacttcaccgaccccgcctccatcgccgcccgggggtacatcagcacgcgcgtgggcatgggcgaggcggccgccatcttcatgaccgccacgccgcccgggaccgcggaggccttcccccagtccaacgcccccatccaggacgaggagcgggacatccccgagcgcagctggaactccggcaacgagtggatcacggacttcgtggggaagaccgtctggttcgtgcccagcatcaaggccggcaacgacatcgccaactgcctgcgcaagaacgggaagaaggtgatccagctgtcccggaagaccttcgacaccgagtaccagaagacgcgcctcaacgactgggacttcgtcgtgaccaccgacatcagcgagatgggcgcgaacttcaaggccgaccgggtgatcgacccccgccggtgcctgaagcccgtcatcctgaccgacggccccgagcgcgtgatcctcgccgggccgatgcccgtgacggccgcctccgcggcccagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagaccttcgtggagctcatgcgccgcggggacctgcccgtctggctggcccacaaggtggccagcgagggcatcaagtacacggaccgcaagtggtgcttcgacggggagcggaacaaccagatcctcgaggagaacatggacgtggagatctggaccaaggagggcgagcgcaagaagctgcggccgcgctggctggacgcgcgcacctactccgaccccctcgccctgaaggagttcaaggacttcgccgccggccgcaagagcatcgccctggacctcgtcaccgagatcgggcgcgtgccctcccacctggcgtaccggacgcgcaacgccctggacaacctcgtgatgctgcacaccagcgagcacggcgggcgggcctaccgccacgccgtcgaggagctgccggagaccatggagaccctcctgctgctcggcctgatgatcctgctcaccggcggggccatgctgttcctgatcagcgggaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcggaccccgcaggacaaccagctcgcctacgtcgtgatcgggatcctgaccctggccgcgatcgtggccgccaacgagatgggcctcctggagacgaccaagcgcgacctgggcatgtccaaggagcccggggtcgtgagccccacctcctacctcgacgtggacctgcaccccgccagcgcctggaccctgtacgcggtcgccacgaccgtgatcaccccgatgctccggcacaccatcgagaactccacggccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacccactacgccatcatcggcccgggcctgcaggccaaggccacgcgcgaggcccagaagcggaccgcggccgggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcgcacgagctgggccctgtgcgaggccctgaccctcgcgaccggccccatcaccacgctgtgggagggctccccggggaagttctggaacaccaccatcgccgtgagcatggccaacatcttccggggctcctacctggccggggcgggcctcgccttcagcatcatgaagtccgtcgggaccggccgccggggcacggggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagaccacgcaccacgccgtgagccggggctccgccaagctccagtggttcgtcgagcgcaacatggtgatccccgaggggcgggtgatcgacctgggctgcgggcgcggcgggtggagctactactgcgcgggcctgaagaaggtcaccgaggtgcgcggctacaccaagggcggccccgggcacgaggagcccgtgccgatgtccacctacggctggaacatcgtcaagctcatgagcgggaaggacgtgttctacctgccgcccgagaagtgcgacacgctgctgtgcgacatcggcgagtccagcccctccccgaccgtggaggagagccggaccatccgcgtcctcaagatggtggagccctggctgaagaacaaccagttctgcatcaaggtgctgaacccctacatgcccaccgtcatcgagcacctcgagcggctgcagcgcaagtacggcgggatgctggtgcggaacccgctctcccgcaacagcacgcacgagatgtactggatctccaacggcaccgggaacatcgtgagctccgtcaacatggtgagccggctgctgctcaaccgcttcaccatgacccaccggcgccccacgatcgagaaggacgtcgacctgggcgccggcacccggcacgtgaacgccgagcccgagaccccgaacatggacgtgatcggggagcgcatcaagcggatcaaggaggagcactccagcacctggcactacgacgacgagaacccctacaagacgtgggcctaccacggctcctacgaggtcaaggccaccgggagcgcgagctccatgatcaacggcgtggtgaagctgctcaccaagccctgggacgtcgtgcccatggtgacccagatggccatgacggacaccaccccgttcgggcagcagcgcgtcttcaaggagaaggtggacacccggacgccccgccccatgcccggcacccggaaggtgatggagatcaccgccgagtggctgtggcgcaccctgggccggaacaagaagccgcgcctctgcacgcgcgaggagttcaccaagaaggtccggaccaacgccgccatgggggcggtgttcaccgaggagaaccagtgggacagcgcccgcgccgccgtggaggacgaggagttctggaagctggtcgaccgggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgcggacgacacggccggctgggacacccgcatcaccgaggacgacctccacaacgaggagaagatcacccagcagatggaccccgagcaccggcagctggccaacgccatcttcaagctgacgtaccagaacaaggtcgtgaaggtgcagcgccccaccccgaaggggaccgtcatggacatcatctcccggaaggaccagcgcggcagcggccaggtggggacctacggcctcaacaccttcacgaacatggaggcccagctggtgcggcagatggagggggagggcgtcctgtccaaggcggacctcgagaacccccacctcctggagaagaagatcacccagtggctcgagaccaagggggtggagcgcctgaagcggatggccatcagcggcgacgactgcgtggtcaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtcgtgccctgccggccccaggacgagctgatcgggcgcgcgcgcatctcccagggcgccgggtggagcctgaaggagaccgcctgcctcggcaaggcctacgcccagatgtggtccctgatgtacttccaccggcgcgacctgcggctcgcgagcaacgccatctgctccgccgtgccggtccactggatccccacgagccgcaccacctggagcatccacgcccaccaccagtggatgaccacggaggacatgctgaccgtgtggaaccgggtgtggatcgaggacaacccctggatggaggacaagacccccgtcaccacgtgggaggacgtgccgtacctgggcaagcgcgaggaccagtggtgcgggtccctcatcggcctgaccagccgggcgacctgggcccagaacatcctgaccgccatccagcaggtccgctccctcatcggggacgaggagttcctggactacatgcccagcatgaagcggttccgcaaggaggaggagtccgagggcgccatctggtga

SEQ ID NO: 10329 - RNA, 9873 nt, synthetic construct
  misc_feature 1..9873: note = derived and/or modified CDS sequence (opt1) from DENV-3__FJ562103__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctaccggtgccccctgatcgccgaggtggagcccgaggacatcgactgctggtgcaacctcaccagcacctgggtgacctacgggacctgcaaccaggccggcgagcaccgccgggacaagcgctccgtggccctggcgccccacgtgggcatggggctggacacccggacccagacctggatgagcgccgagggcgcctggcgccaggtggagaaggtggagacctgggccctccggcacccggggttcaccatcctggcgctgttcctcgcccactacatcggcacctccctgacccagaaggtggtgatcttcacgctgctcatgctggtcacccccagcatgaccatgcgctgcgtgggggtgggcaaccgggacttcgtcgagggcctgtccggggccacctgggtggacgtggtcctcgagcacggcgggtgcgtgacgaccatggccaagaacaagcccaccctggacatcgagctgcagaagaccgaggccacgcagctcgcgaccctgcgcaagctgtgcatcgagggcaagatcaccaacatcaccacggacagccggtgccccacccagggcgaggccatcctcccggaggagcaggaccagaactacgtgtgcaagcacacctacgtcgaccgcgggtggggcaacgggtgcggcctgttcgggaagggctccctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggccagcaccgtggaggccgtgctgcccgagtacggcaccctcgggctggagtgctccccgcggaccggcctggacttcaacgagatgatcctcctgacgatgaagaacaaggcgtggatggtccaccgccagtggttcttcgacctgcccctcccctggaccagcggcgccaccaccgagacgcccacctggaaccggaaggagctgctggtgaccttcaagaacgcccacgccaagaagcaggaggtggtcgtgctcgggtcccaggagggcgccatgcacaccgcgctgacgggggccaccgagatccagaacagcggcgggacctccatcttcgccggccacctgaagtgccgcctcaagatggacaagctggagctgaagggcatgagctacgccatgtgcctcaacaccttcgtgctgaagaaggaggtctccgagacgcagcacgggaccatcctgatcaaggtggagtacaagggcgaggacgccccgtgcaagatccccttcagcaccgaggacgggcagggcaaggcgcacaacggccggctgatcaccgccaaccccgtggtcacgaagaaggaggagcccgtgaacatcgaggccgagccgcccttcggggagagcaacatcgtgatcggcatcgggaacaaggccctcaagatcaactggtacaagaagggctccagcatcgggaagatgttcgaggcgaccgcccgcggcgcccggcgcatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacgtggatcggcctgaacagcaagaacacctccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacgtggaccgagcagtacaagttccaggcggactcccccaagcgcctggccaccgccatcgccggcgcctgggagaacggggtgtgcggcatccggagcaccacgcgcatggagaacctcctgtggaagcagatcgcgaacgagctgaactacatcctctgggagaacaacatcaagctgaccgtggtcgtgggggacatcatcggcgtgctggagcagggcaagcggaccctcacgccccagccgatggagctgaagtactcctggaagacgtgggggaaggccaagatcgtcaccgccgagacccagaacagctccttcatcatcgacggccccaacacccccgagtgccccagcgcctcccgcgcgtggaacgtgtgggaggtggaggactacgggttcggcgtcttcacgaccaacatctggctgaagctccgggaggtgtacacccagagctgcgaccaccgcctgatgagcgccgccatcaaggacgagcgggccgtgcacgccgacatgggctactggatcgagtcccagaagaacgggagctggaagctggagaaggcgtccttcatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccgggccctggcacctcggcaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtctccgccggcagcgggaaggtggacaacttcaccatgggcgtgctgtgcctcgccatcctgttcgaggaggtcatgcgcgggaagttcggcaagaagcacatgatcgcgggggtgctgttcacgttcgtgctcctgctgtccggccagatcacctggcgggacatggcccacaccctcatcatgatcggcagcaacgcctccgaccgcatggggatgggcgtcacctacctggccctgatcgccacgttcaagatccagcccttcctcgcgctggggttcttcctgcggaagctcaccagccgcgagaacctgctgctcggcgtgggcctggccatggccaccaccctgcagctccccgaggacatcgagcagatggccaacgggatcgcgctgggcctgatgacgctcaagctgatcacccagttcgagacctaccagctgtggaccgccctcgtgagcctgacgtgctccaacaccatcttcaccctgaccgtcgcctggcggacggccaccctcatcctggccggggtgagcctgctcccgctgtgccagtccagctccatgcgcaagaccgactggctgcccatgaccgtcgcggccatgggcgtgccgcccctgccgctgttcatcttcagcctgaaggacacgcccaagcgccggtcctggcccctcaacgagggggtgatggccgtcggcctggtgagcatcctggcctccagcctcctgcgcaacgacgtgcccatggccggcccgctggtcgccggcgggctcctgatcgcctgctacgtgatcaccgggacctccgccgacctgaccgtggagaaggccgccgacgtcacgtgggaggaggaggcggagcagaccggggtgagccacaacctcatgatcaccgtggacgacgacgggaccatgcggatcaaggacgacgagaccgagaacatcctgacggtcctgctcaagaccgccctgctgatcgtgtccggcatcttcccctacagcatccccgccaccctcctggtgtggcacacctggcagaagcagacgcagcgctccggcgtcctgtgggacgtgcccagcccgcccgagacccagaaggccgagctcgaggagggggtgtaccggatcaagcagcagggcatcttcgggaagacccaggtcggcgtgggggtgcagaaggagggcgtcttccacaccatgtggcacgtgacgcgcggcgccgtgctgacccacaacgggaagcggctggagcccaactgggcgtccgtcaagaaggacctcatcagctacggcgggggctggcgcctgtccgcccagtggcagaagggggaggaggtccaggtgatcgccgtcgagcccggcaagaacccgaagaacttccagaccatgcccggcatcttccagaccacgaccggggagatcggcgccatcgcgctggacttcaagcccgggaccagcggcagcccgatcatcaaccgggagggcaaggtggtggggctgtacggcaacggggtcgtgaccaagaacggcgggtacgtgtccggcatcgcccagacgaacgccgagcccgacggccccacccccgagctcgaggaggagatgttcaagaagcgcaacctgaccatcatggacctgcacccggggagcggcaagacccggaagtacctccccgccatcgtccgcgaggccatcaagcggcgcctgcggacgctgatcctcgcgcccacccgcgtggtggccgccgagatggaggaggccctgaaggggctgcccatccggtaccagaccaccgccacgaagtccgagcacaccggccgcgagatcgtcgacctcatgtgccacgcgaccttcaccatgcggctgctgagcccggtgcgcgtgcccaactacaacctcatcatcatggacgaggcccacttcacggaccccgcctccatcgccgcccgggggtacatcagcacccgcgtcggcatgggcgaggcggccgccatcttcatgaccgccacgccgcccgggacggcggaggccttcccccagtccaacgcccccatccaggacgaggagaaggacatccccgagcgcagctggaactccggcaacgagtggatcaccgacttcgtggggaagaccgtgtggttcgtccccagcatcaaggccggcaacgacatcgccaactgcctgcggaagaacgggaagaaggtgatccagctgtcccgcaagaccttcgacacggagtaccagaagacccggctcaacgactgggacttcgtggtcaccaccgacatcagcgagatgggcgcgaacttcaaggccgaccgcgtgatcgacccccggcgctgcctgaagcccgtgatcctgacggacggccccgagcgggtcatcctcgccgggccgatgcccgtgaccgccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagacgttcgtcgagctcatgcggcgcggggacctgcccgtgtggctggcccacaaggtcgccagcgagggcatcaagtacaccgaccggaagtggtgcttcgacggggagcgcaacaaccagatcctcgaggagaacatggacgtggagatctggaccaaggagggcgagcggaagaagctgcgcccgcgctggctggacgcgcggacctactccgaccccctcgccctgaaggagttcaaggacttcgccgccggccgcaagagcatcgccctggacctcgtgacggagatcgggcgggtcccctcccacctggcgtaccgcacccggaacgccctggacaacctcgtgatgctgcacaccagcgagcacggcgggcgcgcctaccggcacgccgtggaggagctgccggagaccatggagacgctcctgctgctcggcctgatgatcctgctcaccgggggcgccatgctgttcctgatcagcggcaaggggatcggcaagacctccatcgggctcatctgcgtcatcgtgagctccggcatgctgtggatggcggacgtgcccctgcagtggatcgccagcgccatcgtcctcgagttcttcatgatggtgctgctgatccccgagcccgagaagcagcgcaccccgcaggacaaccagctcgcctacgtggtcatcgggatcctgacgctggccgcgatcgtggccgccaacgagatgggcctcctggagaccaccaagcgggacctgggcatgtccaaggagcccggggtggtcagccccacctcctacctcgacgtggacctgcaccccgccagcgcctggacgctgtacgcggtggccaccaccgtcatcaccccgatgctccgccacacgatcgagaactccaccgccaacgtgagcctggccgcgatcgccaaccaggccgtggtcctgatgggcctcgacaaggggtggcccatctccaagatggacctgggcgtgcccctgctcgccctggggtgctacagccaggtgaaccccctgaccctcaccgccgcggtcctgctgctcgtgacgcactacgccatcatcggcccgggcctgcaggccaaggccacccgggaggcccagaagcgcaccgcggccgggatcatgaagaaccccaccgtggacggcatcatgacgatcgacctggaccccgtcatctacgactccaagttcgagaagcagctcggccaggtgatgctgctggtgctctgcgccgtccagctgctgctcatgcggaccagctgggccctgtgcgaggccctgaccctcgcgaccggccccatcacgaccctgtgggagggctccccggggaagttctggaacaccaccatcgccgtgagcatggccaacatcttccgcggctcctacctggccggggcgggcctcgccttcagcatcatgaagtccgtggggacgggccggcgcggcaccgggagccagggcgagaccctgggggagaagtggaagaagaagctgaaccagctcagccggaaggagttcgacctgtacaagaagtccggcatcaccgaggtcgaccgcaccgaggccaaggaggggctgaagcggggcgagacgacccaccacgccgtgagccgcggctccgccaagctccagtggttcgtggagcggaacatggtcatccccgaggggcgcgtgatcgacctgggctgcgggcgcggcgggtggagctactactgcgcgggcctgaagaaggtgaccgaggtccggggctacaccaagggcgggcccgggcacgaggagcccgtgccgatgtccacgtacggctggaacatcgtgaagctcatgagcgggaaggacgtcttctacctgccgcccgagaagtgcgacaccctgctgtgcgacatcggcgagtccagcccctccccgaccgtggaggagagccgcaccatccgggtgctcaagatggtcgagccctggctgaagaacaaccagttctgcatcaaggtgctgaacccctacatgcccacggtgatcgagcacctcgagcgcctgcagcggaagtacggcgggatgctggtccgcaacccgctctcccggaacagcacccacgagatgtactggatctccaacggcaccgggaacatcgtgagctccgtgaacatggtcagccgcctgctgctcaaccggttcaccatgacgcaccgccggcccaccatcgagaaggacgtggacctgggcgccggcacccgccacgtcaacgccgagcccgagaccccgaacatggacgtgatcggggagcggatcaagcgcatcaaggaggagcactccagcacgtggcactacgacgacgagaacccctacaagacctgggcctaccacggctcctacgaggtgaaggccaccgggagcgcgagctccatgatcaacggcgtcgtgaagctgctcaccaagccctgggacgtggtccccatggtgacgcagatggccatgaccgacaccaccccgttcgggcagcagcgggtgttcaaggagaaggtcgacacgcgcacgccccggcccatgcccggcacccgcaaggtgatggagatcaccgccgagtggctgtggcggacgctgggccgcaacaagaagccgcgcctctgcacccgggaggagttcaccaagaaggtgcgcaccaacgccgccatgggggcggtcttcacggaggagaaccagtgggacagcgcccgggccgccgtggaggacgaggagttctggaagctggtggaccgcgagcgggagctgcacaagctcggcaagtgcgggtcctgcgtctacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgcggacgacaccgccggctgggacacccggatcaccgaggacgacctccacaacgaggagaagatcacgcagcagatggaccccgagcaccgccagctggccaacgccatcttcaagctgacctaccagaacaaggtggtcaaggtgcagcggcccaccccgaaggggaccgtgatggacatcatctcccgcaaggaccagcggggcagcggccaggtcgggacctacggcctcaacacgttcaccaacatggaggcccagctggtgcgccagatggagggggagggcgtgctgtccaaggcggacctcgagaacccccacctcctggagaagaagatcacccagtggctcgagaccaagggggtcgagcggctgaagcgcatggccatcagcggcgacgactgcgtggtgaagcccatcgacgaccggttcgccaacgccctgctcgccctgaacgacatgggcaaggtccgcaaggacatcccccagtggcagccgtccaaggggtggcacgactggcagcaggtccccttctgcagccaccacttccacgagctgatcatgaaggacggccggaagctcgtggtcccctgccgcccccaggacgagctgatcgggcgcgcgcggatctcccagggcgccgggtggagcctgaaggagacggcctgcctcggcaaggcctacgcccagatgtggtccctgatgtacttccaccgccgggacctgcgcctcgcgagcaacgccatctgctccgccgtgccggtgcactggatccccaccagccggaccacctggagcatccacgcccaccaccagtggatgacgaccgaggacatgctgaccgtctggaaccgcgtgtggatcgaggacaacccctggatggaggacaagacccccgtgacgacctgggaggacatcccgtacctgggcaagcgggaggaccagtggtgcgggtccctcatcggcctgaccagccgcgcgacctgggcccagaacatcctgacggccatccagcaggtccggtccctcatcggggacgaggagttcctggactacatgcccagcatgaagcgcttccggaaggaggaggagtccgagggcgccatctggtga

SEQ ID NO: 10330 - RNA, 9873 nt, synthetic construct
  misc_feature 1..9873: note = derived and/or modified CDS sequence (opt1) from DENV-3__FJ898456__SS-prME
  source 1..9873: mol_type = other RNA
accagcctgtgcctcatgatgatgctgcccgccaccctggccttccacctcacctcccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacgtggatgagcgcggagggcgcctggcgccaggtggagaaggtggagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcatcctggagcagggcaagcggaccctgacgccccagcccatggagctcaagtacagctggaagacgtgggggaaggccaagatcgtcaccgccgagacccagaactccagcttcatcatcgacggcccgaacacccccgagtgcccctccgcgagccgcgcctggaacgtgtgggaggtggaggactacgggttcggcgtcttcacgaccaacatctggctgaagctgcgggagatgtacacccagctctgcgaccaccgcctgatgagcgccgccgtgaaggacgagcgggccgtgcacgcggacatgggctactggatcgagtcccagaagaacgggagctggaagctggagaaggcctccctcatcgaggtcaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtggtcatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtctccgccggcagcgggaaggcggacaacttcaccatgggcgtgctctgcctggccatcttcttcgaggaggtgatgcgcgggaagttcggcaagaagcacatgatcgccggggccctgttcacgttcgtcctcctgctgtccggccagatcacctggcgggacatggcccacaccctcatcatgatcggcagcaacgcgtccgaccgcatggggatgggcgtgacctacctggccctgatcgccacgttcaagatccagcccttcctcgccctggggttcttcctgcggaagctcaccagccgcgagaacctgctgctcggcgtgggcctggcgatggccaccaccctgcagctccccgaggacatcgagcagatggccaacgggatcgccctgggcctgatggccctcaagctgatcacgcagttcgagacctaccagctgtggaccgcgctcgtcagcctgatgtgctccaacaccatcttcacgctgaccgtggcctggcggaccgccaccctcatcctggccgtgatcagcctgctccccgtctgccagtccagctccatgcgcaagacggactggctgccgatgaccgtggccgcgatgggggtgcccagcctgcccctcttcatcttctccctgaaggacaccctgaagcggcgcagctggcccctcaacgagggcgtcatggccgtggggctggtctccatcctggccagctccttcctccgcaacgacgtgccgatggccggccccctggtggccggcgggctgctcatcgcgtgctacgtcatcaccggcacgagcgccgacctgaccgtggagaaggccgccgacgtgacctgggaggaggaggccgagcagaccggggtctcccacaacctgatgatcacggtggacgacgacggcaccatgcggatcaaggacgacgagaccgagaacatcctcaccgtgctgctgaagaccgcgctcctgatcgtcagcgggatcttcccctactccatccccgccacgctgctcgtgtggcacacctggcagaagcagacccagcgcagcggcgtgctgtgggacgtcccgagcccgcccgagacccagaaggccgagctggaggagggcgtgtaccggatcaagcagcaggggatcttcggcaagacccaggtgggggtcggcgtgcagaaggagggggtgttccacaccatgtggcacgtcacccgcggcgccgtgctcacccacaacggcaagcggctggagcccaactgggcgaacgtgaagaaggacctgatcagctacgggggcgggtggaagctctccgcccagtggcagaagggcgaggaggtccaggtgatcgccgtggagccggggaagaaccccaagagcttccagacgatgcccggcatcttccagaccaccaccggcgagatcggggccatcgccctggacttcaagcccggcacgagcgggtccccgatcatcaaccgcgagggcaaggtcgtgggcctgtacgggaacggcgtggtcaccaagaacgggggctacgtgagcgggatcgcgcagaccaacgccgagcccgacggccccaccccggagctggaggaggagatgttcaagaagcggaacctcacgatcatggacctgcaccccggctccgggaagacccgcaagtacctgcccgccatcgtgcgggaggccatcaagcgccggctccgcaccctgatcctggcccccacccgggtcgtggcggccgagatggaggaggccctcaagggcctgccgatccgctaccagacgaccgccaccaagagcgagcacaccgggcgggagatcgtggacctgatgtgccacgccacgttcaccatgcgcctcctgtcccccgtccgggtgcccaactacaacctgatcgtgatggacgaggcgcacttcaccgaccccgccagcatcgccgcccgcggctacatctccacccgggtcgggatgggcgaggcggccgccatcttcatgacggccaccccgcccggcaccgccgacgcgttcccccagagcaacgcccccatccaggacgaggagcgcgacatcccggagcggtcctggaacagcgggaacgagtggatcaccgacttcgccggcaagacggtgtggttcgtgccctccatcaaggccgggaacgacatcgccaactgcctccgcaagaacggcaagaaggtcatccagctgagccgcaagaccttcaacaccgagtaccagaagaccaagctgaacgactgggacttcgtggtgacgaccgacatctccgagatgggggcgaacttcaaggccgaccgggtcatcgacccccgccggtgcctcaagcccgtgatcctgaccgacggcccggagcgcgtgatcctggccggccccatgcccgtcaccgtggccagcgccgcgcagcggcgcgggcgggtgggccgcaacccccagaaggagaacgaccagtacatcttcacggggcagccgctcaacaacgacgaggaccacgcccactggaccgaggccaagatgctgctggacaacatcaacacccccgagggcatcatccccgccctcttcgagcccgagcgggagaagtccgcggccatcgacggggagtaccgcctgaagggcgagagccggaagaccttcgtcgagctgatgcgccggggcgacctcccggtgtggctggcccacaaggtggcctccgaggggatcaagtacaccgaccgcaagtggtgcttcgacggcgagcggaacaaccagatcctggaggagaacatggacgtcgagatctggacgaaggagggggagaagaagaagctccgcccccggtggctggacgcccgcacctacagcgaccccctggcgctcaaggagttcaaggacttcgccgccggccggaagtccatcgccctggacctggtgaccgagatcggccgcgtccccagccacctcgcccaccgcacccggaacgcgctggacaacctggtgatgctccacacgagcgagcacgggggccgcgcctaccggcacgccgtggaggagctgccggagaccatggagaccctgctcctgctggggctcatgatcctgctgaccggcggggccatgctgttcctgatctccggcaagggcatcgggaagacgagcatcggcctgatctgcgtcgtggcctccagcgggatgctctggatggcggacgtgcccctgcagtggatcgcctccgccatcgtcctggagttcttcatgatggtgctcctgatccccgagccggagaagcagcgcacgccccaggacaaccagctggcctacgtggtcatcggcatcctcaccctggccgcgatcgtggccgccaacgagatggggctgctcgagaccacgaagcgggacctgggcatgagcaaggagcccggcgtggtctcccccaccagctacctggacgtggacctccacccggcctccgcgtggaccctgtacgccgtggccaccacggtcatcacccccatgctgcgccacaccatcgagaacagcaccgccaacgtgtccctcgccgcgatcgccaaccaggccgtggtcctgatggggctggacaagggctggcccatcagcaagatggacctcggggtgcccctgctggccctcggctgctactcccaggtgaacccgctgacgctgaccgccgcggtcctcctgctggtgacccactacgccatcatcgggcccggcctccaggccaaggccacccgggaggcccagaagcgcacggcggccggcatcatgaagaaccccaccgtggacgggatcatgaccatcgacctggaccccgtcatctacgacagcaagttcgagaagcagctgggccaggtgatgctcctggtgctgtgcgccgtccagctcctgctgatgcggacctcctgggccttctgcgaggcgctcacgctggccaccgggccgatcaccaccctgtgggagggcagccccggcaagttctggaacacgaccatcgccgtgtccatggccaacatcttccgcgggagctacctcgccggcgcggggctggccttctccatcatgaagtccgtgggcaccgggaagcggggcaccggcagccagggggagacgctgggcgagaagtggaagaagaagctcaaccagctgagccgcaaggagttcgacctgtacaagaagtccgggatcaccgaggtcgagcggaccgaggccaaggagggcctcaagcgcggggagatcacccaccacgccgtgtcccggggcagcgccaagctgcagtggttcgtggagcgcaacatggtcatccccgagggccgggtgatcgacctggggtgcggccgcgggggctggtcctactactgcgcggggctcaagaaggtgaccgaggtccggggctacacgaagggcgggcccggccacgaggagccggtgcccatgagcacctacgggtggaacatcgtgaagctgatgtccggcaaggacgtcttctacctgccgcccgagaagtgcgacaccctcctgtgcgacatcggggagagctccccgagccccaccgtggaggagtcccgcacgatccgggtgctgaagatggtcgagccctggctgaagaacaaccagttctgcatcaaggtgctcaacccctacatgccgaccgtgatcgagcacctggagcgcctgcagcgcaagcacggcggcatgctcgtccggaaccccctgagccgcaactccacccacgagatgtactggatcagcaacgggaccggcaacatcgtgtccagcgtgaacatggtctcccggctgctcctgaaccgcttcacgatgacccaccggcgccccaccatcgagaaggacgtggacctgggggccggcacccggcacgtgaacgccgagcccgagacgccgaacatggacgtcatcggcgagcgcatccggcgcatcaaggaggagcacagctccacctggcactacgacgacgagaacccctacaagacctgggcctaccacgggagctacgaggtgaaggccaccggcagcgcgtccagcatgatcaacggggtcgtgaagctcctgacgaagccctgggacgtggtcccgatggtgacccagatggccatgaccgacaccacgcccttcggccagcagcgggtgttcaaggagaaggtcgacacccgcacgccccggcccatgccggggacccgcaaggtgatggagatcacggccgagtggctgtggcggaccctcggccgcaacaagcggccccgcctgtgcacccgggaggagttcatcaagaaggtgcgcaccaacgccgcgatgggcgccgtcttcacggaggagaaccagtgggactccgcccgcgccgccgtggaggacgaggagttctggaagctggtggaccgggagcgcgagctccacaagctggggaagtgcggcagctgcgtctacaacatgatggggaagcgggagaagaagctgggcgagttcgggaaggcgaagggctcccgcgccatctggtacatgtggctcggcgcccggtacctggagttcgaggccctggggttcctcaacgaggaccactggttcagccgcgagaactcctacagcggcgtggagggggagggcctgcacaagctggggtacatcctccgggacatctccaagatccccggcggcgccatgtacgcggacgacaccgccgggtgggacacccgcatcaccgaggacgacctgcacaacgaggagaagatcacgcagcagatggaccccgagcaccggcgcctggccaacgccatcttcaagctcacctaccagaacaaggtggtcaaggtgcagcggccgacccccaagggcaccgtgatggacatcatcagccgcaaggaccagcgggggtccggccaggtcggcacgtacgggctgaacaccttcaccaacatggaggcccagctgatccgccagatggagggcgagggggtgctcagcaaggcggacctggagaacccccacctcctcgagaagaaggtgacccagtggctggagaccaagggcgtcgagcggctgaagcgcatggccatctccggggacgactgcgtggtgaagcccatcgacgaccggttcgccaacgccctcctggccctgaacgacatgggcaaggtccgcaaggacatcccgcagtggcagcccagcaagggctggcacgactggcagcaggtccccttctgctcccaccacttccacgagctcatcatgaaggacgggcggaagctggtggtcccctgccgcccgcaggacgagctgatcggccgggcgcgcatcagccagggggccggctggtccctccgcgagacggcctgcctggggaaggcctacgcgcagatgtgggccctgatgtacttccaccggcgcgacctccggctggccagcaacgccatctgctccgccgtgcccgtgcactgggtccccaccagccgcaccacctggagcatccacgcgcaccaccagtggatgacgaccgaggacatgctgaccgtgtggaaccgggtgtggatcgaggacaacccctggatggaggacaagaccccggtcacgacctgggaggacgtgccctacctcggcaagcgcgaggaccagtggtgcggctccctgatcgggctggccagccgggccacctgggcccagaacatcctcaccgccatccagcaggtccgctccctgatcggcaacgaggagttcctggactacatgcccagcatgaagcggttccgcaaggaggaggagtccgagggggcgatctggtga

SEQ ID NO: 10331 - RNA, 9873 nt, synthetic construct
  misc_feature 1..9873: note = derived and/or modified CDS sequence (opt1) from DENV-3__JN697379__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgcccccacatcaccgaggtggagcccgaggacatcgactgctggtgcaacctgaccagcacctgggtgacgtacgggacctgcaaccaggccggcgagcaccggcgcgacaagcggtccgtcgccctcgccccccacgtgggcatggggctggacacccgcacccagacgtggatgagcgcggagggcgcctggcggcaggtggagaaggtcgagacctgggccctgcgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcgatcctgccggaggagcaggaccagaactacgtgtgcaagcacacctacgtcgaccgggggtggggcaacgggtgcggcctcttcgggaagggctccctggtgacctgcgccaagttccagtgcctggagagcatcgagggcaaggtggtccagcacgagaacctcaagtacacggtgatcatcaccgtgcacaccggggaccagcaccaggtcggcaacgagacccagggggtgacggccgagatcacctcccaggccagcaccgccgaggtcatcctgcccgagtacggcaccctggggctcgagtgctccccccgcaccggcctggacttcaacgagatgatcctgctcacgatgaagaacaaggcgtggatggtgcaccggcagtggttcttcgacctgcccctgccgtggaccagcggcgccaccaccgagacgcccacctggaaccgcaaggagctcctggtgaccttcaagaacgcccacgccaagaagcaggaggtcgtggtgctggggtcccaggagggcgccatgcacaccgcgctcacgggggccaccgagatccagaccagcggcgggacctccatcttcgccggccacctgaagtgccggctgaagatggacaagctcaagctgaagggcatgagctacgccatgtgcctgaacacgttcgtcctcaagaaggaggtgagcgagacccagcacgggaccatcctgatcaaggtggagtacaagggcgaggacgccccctgcaagatccccttctccaccgaggacgggcagggcaaggcgcacaacggccgcctgatcacggccaacccggtcgtgaccaagaaggaggagcccgtgaacatcgaggccgagccccccttcggggagagcaacatcgtcatcggcatcggggacaaggccctgaagatcaactggtaccggaagggctccagcatcgggaagatgttcgaggcgaccgcccgcggcgcccggcgcatggccatcctcggcgacaccgcctgggacttcgggtccgtgggcggggtgctgaacagcctgggcaagatggtccaccagatcttcgggtccgcgtacacggccctcttcagcggcgtgtcctggatcatgaagatcggcatcggggtgctgctgacctggatcggcctcaacagcaagaacacctccatgagcttctcctgcatcgccatcgggatcatcaccctgtacctgggcgtcgtggtgcaggccgacatggggtgcgtcatcaactggaagggcaaggagctcaagtgcggcagcgggatcttcgtgacgaacgaggtgcacacctggaccgagcagtacaagttccaggccgactccccgaagcgcctggcgaccgccatcgccggcgcctgggagaacggggtctgcggcatccggagcacgacccgcatggagaacctgctctggaagcagatcgccaacgagctgaactacatcctgtgggagaacaacatcaagctcaccgtggtggtcggggacatcaccggcgtgctggagcagggcaagcggacgctgaccccccagcccatggagctcaagtactcctggaagacctgggggaaggcgaagatcgtgaccgccgagacgcagaacagctccttcatcatcgacggccccagcaccccggagtgccccagcgcctcccgcgcctggaacgtctgggaggtggaggactacgggttcggcgtgttcaccaccaacatctggctgaagctgcgggaggtctacacccagctctgcgaccaccgcctgatgagcgcggccgtgaaggacgagcgggccgtgcacgccgacatgggctactggatcgagtcccagaagaacgggagctggaagctggagaaggcctccctcatcgaggtcaagacgtgcacctggcccaagagccacaccctgtggtccaacggcgtgctggagagcgacatgatcatccccaagtccctcgcggggccgatcagccagcacaaccaccgccccggctaccacacccagacggccgggccctggcacctgggcaagctggagctcgacttcaactactgcgagggcaccaccgtggtcatctccgagaactgcgggacccggggcccgagcctgcgcacgaccaccgtgtccgggaagctgatccacgagtggtgctgccggagctgcaccctcccccccctgcgctacatgggcgaggacgggtgctggtacggcatggagatccggcccatcaacgagaaggaggagaacatggtgaagtccctggccagcgccggctccgggaaggtcgacaacttcacgatgggcgtgctctgcctggccatcctgttcgaggaggtgatgcgcgggaagttcggcaagaagcacatgatcgcgggggtcctcttcaccttcgtgctgctgctcagcggccagatcacctggcgggacatggcccacaccctgatcatgatcggcagcaacgtgtccgaccgcatggggatgggcgtcacgtacctggccctcatcgccaccttcaagatccagccgttcctggccctggggttcttcctccggaagctgaccagccgcgagaacctgctcctgggcgtgggcctggcgatggccgccaccctccggctgcccgaggacatcgagcagatggccaacgggatcgcgctgggcctcatggccctgaagctgatcacgcagttcgagacctaccagctctggaccgccctggtgtccctgacctgcagcaacacgatcttcaccctcaccgtcgcctggcgcaccgccacgctgatcctggcggggatctccctcctgcccgtgtgccagagctccagcatgcgcaagaccgactggctgcccatgaccgtcgccgccatgggcgtgccgcccctccccctgttcatcttctccctgaaggacaccctcaagcggcgcagctggcccctgaacgagggggtgatggccgtcggcctggtgtccatcctcgccagctccctgctgcggaacgacgtgccgatggcgggccccctcgtcgccgggggcctgctgatcgcctgctacgtgatcacggggaccagcgccgacctcaccgtggagaaggccgcggacgtcacctgggaggaggaggccgagcagacgggcgtgtcccacaacctgatgatcaccgtggacgacgacgggaccatgcgcatcaaggacgacgagaccgagaacatcctgaccgtcctcctgaagacggccctgctcatcgtgagcggcatcttcccctactccatccccgccaccctgctggtgtggcacacctggcagaagcagacccagcggagcggcgtcctctgggacgtgccgtccccccccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgcggtgctgacgcacaacgggaagcgcctcgagcccaactgggccagcgtcaagaaggacctgatcagctacggcgggggctggcggctgtccgcccagtggcagaagggggaggaggtgcaggtgatcgccgtcgagccgggcaagaaccccaagaacttccagaccatgcccggcatcttccagaccaccacgggggagatcggcgcgatcgccctggacttcaagcccgggaccagcggctccccgatcatcaaccgcgagggcaaggtggtggggctctacggcaacggggtcgtgaccaagaacggcgggtacgtgagcggcatcgcccagaccaacgccgagcccgacggccccacgccggagctggaggaggagatgttcaagaagcggaacctgaccatcatggacctccaccccgggtccggcaagacccgcaagtacctgcccgccatcgtccgggaggcgatcaagcgccggctgcgcaccctcatcctggcccccacgcgggtggtggccgccgagatggaggaggccctgaaggggctcccgatccgctaccagaccaccgcgaccaagagcgagcacacgggccgggagatcgtcgacctgatgtgccacgccaccttcaccatgcgcctgctctcccccgtgcgggtgcccaactacaacctgatcatcatggacgaggcccacttcaccgaccccgccagcatcgccgcgcgcgggtacatctccacgcgcgtcggcatgggcgaggccgccgccatcttcatgaccgcgaccccgcccgggaccgccgacgccttcccccagagcaacgcccccatccaggacgaggagcgggacatcccggagcgctcctggaacagcggcaacgagtggatcacggacttcgtggggaagaccgtgtggttcgtcccctccatcaaggccggcaacgacatcgcgaactgcctgcggaagaacgggaagaaggtgatccagctcagccgcaagaccttcgacaccgagtaccagaagacgaagctgaacgactgggacttcgtggtcaccaccgacatctccgagatgggcgccaacttcaaggccgaccgggtgatcgacccccgccggtgcctgaagcccgtgatcctcaccgacggcccggagcgcgtcatcctggccgggcccatgcccgtgacggtggccagcgcggcccagcggcgcggccgggtcgggcgcaacccccagaaggagaacgaccagtacatcttcatgggccagccgctgaacaacgacgaggaccacgcccactggaccgaggccaagatgctcctggacaacatcaacacccccgaggggatcatccccgccctgttcgagcccgagcgggagaagtccgcggccatcgacggcgagtaccgcctcaagggcgagagccggaagaccttcgtggagctgatgcgccggggggacctgccggtctggctcgcccacaaggtggcctccgagggcatcaagtacaccgaccgcaagtggtgcttcgacggggagcggaacaaccagatcctggaggagaacatggacgtggagatctggacgaaggagggcgagaagaagaagctgcgcccccgctggctcgacgcgcggacctacagcgaccccctggccctgaaggagttcaaggacttcgccgccggccgcaagagcatcgccctcgacctggtcaccgagatcgggcgggtgccctcccacctggcgcaccgcacccggaacgccctcgacaacctggtgatgctgcacacgagcgagcacggcgggcgcgcctaccggcacgccgtcgaggagctcccggagaccatggagaccctgctgctcctgggcctgatgatcctcctgaccgggggcgccatgctgttcctcatctccggcaaggggatcggcaagacgagcatcgggctgatctgcgtgatcgcgtccagcggcatgctgtggatggccgacgtgcccctccagtggatcgcctccgccatcgtcctggagttcttcatgatggtgctgctcatccccgagccggagaagcagcgcaccccccaggacaaccagctggcctacgtggtcatcgggatcctgaccctcgcggccatcgtggccgccaacgagatgggcctgctggagaccacgaagcgggacctcggcatgagcaaggagcccggggtggtctcccccaccagctacctggacgtggacctgcacccggcctccgcgtggaccctctacgccgtggccaccacggtcatcacccccatgctgcgccacaccatcgagaacagcaccgccaacgtgtccctggcggccatcgccaaccaggccgtggtcctcatgggcctggacaaggggtggcccatcagcaagatggacctgggcgtgcccctcctggccctggggtgctactcccaggtgaacccgctcacgctggcggccgccgtcctgctcctggtgacccactacgccatcatcggccccggcctgcaggccaaggcgacccgggaggcccagaagcgcaccgccgccgggatcatgaagaaccccacggtggacggcatcatgaccatcgacctcgaccccgtcatctacgacagcaagttcgagaagcagctggggcaggtgatgctgctcgtgctgtgcgccgtccagctgctcctgatgcggacctcctgggcgctgtgcgaggtgctcaccctggccacgggcccgatcaccaccctgtgggagggcagccccgggaagttctggaacaccacgatcgccgtgtccatggccaacatcttccgcggcagctacctcgcgggggccggcctggccttcagcatcatgaagtccgtcgggaccggcaagcggggcaccgggagccagggcgagaccctgggggagaagtggaagaagaagctcaaccagctgtcccgcaaggagttcgacctgtacaagaagagcggcatcacggaggtggaccggaccgaggccaaggaggggctcaagcgcggcgagatcacccaccacgccgtgtcccggggcagcgcgaagctgcagtggttcgtcgagcgcaacatggtgatccccgaggggcgggtgatcgacctgggctgcgggcgcggcgggtggtcctactactgcgccggcctcaagaaggtcaccgaggtgcgcggctacaccaaggggggccccgggcacgaggagccggtgcccatgagcacgtacggctggaacatcgtcaagctgatgtccgggaaggacgtgttctacctgccccccgagaagtgcgacaccctgctctgcgacatcggcgagagctccccgagccccaccgtggaggagtcccggaccatccgcgtcctgaagatggtggagccctggctgaagaacaaccagttctgcatcaaggtgctcaacccctacatgccgacggtcatcgagcacctggagcggctgcagcgcaagcacggcgggatgctcgtgcggaaccccctgagccgcaactccacccacgagatgtactggatcagcaacggcaccgggaacatcgtgtccagcgtcaacatggtgtcccggctgctcctgaaccgcttcaccatgacgcaccggcgccccaccatcgagaaggacgtcgacctgggcgccggcacccggcacgtgaacgccgagcccgagaccccgaacatggacgtgatcggggagcgcatcaagcggatcaaggaggagcacagcagcacgtggcactacgacgacgagaacccctacaagacctgggcctaccacggctcctacgaggtcaaggcgaccgggagcgcctccagcatgatcaacggcgtggtgaagctcctgaccaagccctgggacgtcgtgccgatggtgacgcagatggccatgaccgacaccacccccttcgggcagcagcgcgtcttcaaggagaaggtggacacgcggaccccccgccccatgccgggcacccggaaggtgatggagatcaccgccgagtggctgtggcgcacgctcggccggaacaagcgcccccgcctgtgcacccgggaggagttcaccaagaaggtccgcaccaacgccgcgatgggggccgtgttcacggaggagaaccagtgggactccgcccgggccgcggtggaggacgaggagttctggaagctggtcgaccgcgagcgggagctccacaagctgggcaagtgcgggagctgcgtgtacaacatgatgggcaagcgcgagaagaagctgggggagttcggcaaggccaagggctcccgggccatctggtacatgtggctcggggcccgctacctggagttcgaggccctgggcttcctcaacgaggaccactggttcagccgggagaactcctacagcggggtggagggcgaggggctgcacaagctgggctacatcctccgcgacatctccaagatccccggcggggcgatgtacgccgacgacaccgccggctgggacacccggatcaccgaggacgacctgcacaacgaggagaagatcacgcagcagatggaccccgagcaccgccagctggccaacgccatcttcaagctcacctaccagaacaaggtcgtgaaggtgcagcggccgacccccaaggggaccgtcatggacatcatcagccgcaaggaccagcggggctccggccaggtggggacgtacggcctgaacaccttcaccaacatggaggcgcagctgatccgccagatggagggggagggcgtgctcagcaaggccgacctggagaacccccaccccctggagaagaagatcacccagtggctcgagaccaagggggtcgagcggctgaagcgcatggccatctccggcgacgactgcgtggtgaagccgatcgacgaccggttcgccaacgccctgctcgcgctgaacgacatgggcaaggtccgcaaggacatcccccagtggcagcccagcaaggggtggcacgactggcagcaggtgcccttctgctcccaccacttccacgagctgatcatgaaggacggccggaagctcgtggtcccgtgccgcccccaggacgagctgatcgggcgcgcccggatcagccagggcgccgggtggtccctgcgcgagacggcctgcctcggcaaggcctacgcgcagatgtggaccctgatgtacttccaccggcgcgacctgcggctcgccagcaacgccatctgcagcgccgtgcccgtgcactgggtccccacctcccgcaccacgtggagcatccacgcgcaccaccagtggatgaccaccgaggacatgctgaccgtgtggaaccgggtgtggatcgaggacaacccgtggatggaggacaagacgcccgtcaccacctgggaggacgtgccctacctgggcaagcgcgaggaccagtggtgcgggtccctcatcggcctgaccagccgggccacgtgggcccagaacatcctgaccgccatccagcaggtgcgctccctcatcgggaacgaggagttcctggactacatgcccagcatgaagcggttccgcaaggaggaggagtccgagggcgccatctggtga

SEQ ID NO: 10332 - RNA, 9873 nt, synthetic construct
  misc_feature 1..9873: note = derived and/or modified CDS sequence (opt1) from DENV-3__JQ045687__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacctacaagtgccccctggtggccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcggcaggtcgagaaggtggagacgtgggccctccgccacccggggttcaccatcctggcgctgttcctcgcccactacatcggcacctccctgacccagaaggtggtcatcttcatcctgctcatgctggtgacgcccagcatgaccatgcggtgcgtgggggtcggcaaccgcgacttcgtggagggcctgtccggggccacctgggtggacgtcgtgctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtctgcaagcacacctacgtggaccgggggtggggcaacgggtgcggcctgttcgggaagggctccctggtgacctgcgccaagttccagtgcctcgagcccatcgagggcaaggtcgtgcagtacgagaacctgaagtacaccgtgatcatcacggtccacaccggggaccagcaccaggtgggcaacgacacccagggggtcaccgtggagatcacgccccaggccagcaccgtggaggccgtcctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaacaagaaggagctgctggtgaccttcaagaacgcccacgccaagaagcaggaggtcgtggtgctcgggtcccaggagggcgccatgcacaccgcgctgaccggggccacggagatccagaacagcggcgggacctccatcttcgccggccacctgaagtgccgcctcaagatggacaagctggagctgaagggcatgagctacgccatgtgcctcaacaccttcgtcctgaagaaggaggtgtccgagacccagcacgggacgatcctgatcaaggtggagtacaagggcgaggacgccccgtgcaagatccccttcagcaccgaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaaggccctcaagatcaactggtacaagaagggctccagcatcgggaagatgttcgaggcgacggcccgcggcgcccggcgcatggccatcctgggcgacaccgcctgggacttcgggtccgtgggcggggtgctgaacagcctcggcaagatggtccaccagatcttcgggtccgcgtacaccgccctgttcagcggcgtgtcctggatcatgaagatcggcatcggggtgctgctcacctggatcggcctgaacagcaagaacacgtccatgagcttctcctgcatcgtcatcgggatcatcaccctgtacctcggcgccgtggtgcaggccgacatggggtgcgccatcaactggaagggcaaggagctgaagtgcggcagcgggatcttcgtcaccaacgaggtgcacacctggacggagcagtacaagttccaggcggactcccccaagcggctggccaccgccatcgccggcgcctgggagaacggggtgtgcggcatccgcagcaccacccgcatggagaacctcctgtggaagcagatcgcgaacgagctgaactacatcctctgggagaacaacatcaagctgacggtcgtggtgggggacatcatcggcgtcctggagcagggcaagcggaccctcacgccccagccgatggagctgaagtactcctggaagacctgggggaaggccaagatcgtgacggccgagacccagaacagctccttcatcatcgacggccccaacacccccgagtgccccagcgcctcccgcgcgtggaacgtgtgggaggtcgaggactacgggttcggcgtgttcaccacgaacatctggctgaagctccgggaggtgtacacccagagctgcgaccaccgcctgatgagcgccgccatcaaggacgagcgggccgtccacgccgacatgggctactggatcgagtcccagaagaacgggagctggaagctggagaaggcgtccttcatcgaggtgaagacctgcacctggcccaagagccacaccctctggtccaacggcgtgctggagagcgacatgatcatccccaagtccctggccgggcccatcagccagcacaaccaccgcccgggctaccacacgcagaccgccgggccctggcacctcggcaagctggagctggacttcaactactgcgagggcaccaccgtcgtgatcacggagaactgcgggacccggggcccctccctccgcaccaccacggtgagcgggaagctgatccacgagtggtgctgccggtcctgcaccctgcccccgctccgctacatgggcgaggacgggtgctggtacggcatggagatccggcccatcaacgagaaggaggagaacatggtcaagagcctggtgtccgccggcagcgggaaggtggacaacttcaccatgggcgtcctgtgcctcgccatcctgttcgaggaggtgatgcgcgggaagttcggcaagaagcacatgatcgcgggggtgctgttcaccttcgtcctcctgctgtccggccagatcacgtggcgggacatggcccacaccctcatcatgatcggcagcaacgcctccgaccgcatggggatgggcgtgacctacctggccctgatcgccaccttcaagatccagcccttcctcgcgctggggttcttcctgcggaagctcacgagccgcgagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgctccaacacgatcttcaccctgaccgtggcctggcggaccgccacgctcatcctggccggggtcagcctgctcccgctgtgccagtccagctccatgcgcaagaccgactggctgcccatgaccgtggcggccatgggcgtgccgcccctgccgctgttcatcttcagcctgaaggacacccccaagcggcgctcctggcccctcaacgagggggtcatggccgtgggcctggtgagcatcctggcctccagcctcctgcgcaacgacgtccccatggccggcccgctggtggccggcgggctcctgatcgcctgctacgtgatcacggggacctccgccgacctgaccgtcgagaaggccgccgacgtgacctgggaggaggaggcggagcagacgggggtgagccacaacctcatgatcaccgtcgacgacgacgggaccatgcggatcaaggacgacgagaccgagaacatcctgaccgtgctgctcaagacggccctgctgatcgtgtccggcatcttcccctacagcatccccgccaccctcctggtctggcacacctggcagaagcagacccagcgctccggcgtgctgtgggacgtgcccagcccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggcgtccgtgaagaaggacctcatcagctacggcgggggctggcgcctgtccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtcgggctgtacggcaacggggtggtgaccaagaacggcgggtacgtctccggcatcgcccagaccaacgccgagcccgacggccccacgcccgagctcgaggaggagatgttcaagaagcgcaacctgaccaccatggacctgcacccggggagcggcaagacccggaagtacctccccgccatcgtgcgcgaggccatcaagcggcgcctgcggacgctgatcctcgcgcccacccgcgtggtcgccgccgagatggaggaggccctgaaggggctgcccatccggtaccagaccaccgccacgaagtccgagcacaccggccgcgagatcgtggacctcatgtgccacgcgaccttcaccatgcggctgctgagcccggtgcgcgtccccaactacaacctcatcatcatggacgaggcccacttcacggaccccgcctccatcgccgcccgggggtacatcagcacccgcgtgggcatgggcgaggcggccgccatcttcatgaccgccacgccgcccgggacggcggaggccttcccccagtccaacgcccccatccaggacgaggagcgggacatccccgagcgcagctggaactccggcaacgagtggatcaccgacttcgtggggaagaccgtctggttcgtgcccagcatcaaggccggcaacgacatcgccaactgcctgcgcaagaacgggaagaaggtgatccagctgtcccggaagaccttcgacacggagtaccagaagacccgcctcaacgactgggacttcgtcgtgaccaccgacatcagcgagatgggcgcgaacttcaaggccgaccgggtgatcgacccccgccggtgcctgaagcccgtcatcctgacggacggccccgagcgcgtgatcctcgccgggccgatgcccgtgaccgccgcctccgcggcccagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagacgttcgtggagctcatgcgccgcggggacctgcccgtctggctggcccacaaggtggccagcgagggcatcaagtacaccgaccgcaagtggtgcttcgacggggagcggaacaaccagatcctcgaggagaacatggacgtggagatctggaccaaggagggcgagcgcaagaagctgcggccgcgctggctggacgcgcgcacctactccgaccccctcgccctgaaggagttcaaggacttcgccgccggccgcaagagcatcgccctggacctcgtcacggagatcgggcgcgtgccctcccacctggcgtaccggacccgcaacgccctggacaacctcgtgatgctgcacaccagcgagcacggcgggcgggcctaccgccacgccgtcgaggagctgccggagaccatggagacgctcctgctgctcggcctgatgatcctgctcaccgggggcgccatgctgttcctgatcagcggcaaggggatcggcaagacctccatcgggctcatctgcgtgatcgtgagctccggcatgctgtggatggcggacgtccccctgcagtggatcgccagcgccatcgtgctcgagttcttcatgatggtgctgctgatccccgagcccgagaagcagcggaccccgcaggacaaccagctcgcctacgtcgtgatcgggatcctgacgctggccgcgatcgtggccgccaacgagatgggcctcctggagaccaccaagcgcgacctgggcatgtccaaggagcccggggtcgtgagccccacctcctacctcgacgtggacctgcaccccgccagcgcctggacgctgtacgcggtcgccaccaccgtgatcaccccgatgctccggcacacgatcgagaactccaccgccaacgtgagcctggccgcgatcgccaaccaggccgtcgtgctgatgggcctcgacaaggggtggcccatctccaagatggacctgggcgtgcccctgctcgccctggggtgctacagccaggtcaaccccctgaccctcaccgccgcggtgctgctgctcgtgacgcactacgccatcatcggcccgggcctgcaggccaaggccacccgcgaggcccagaagcggaccgcggccgggatcatgaagaaccccaccgtcgacggcatcatgacgatcgacctggaccccgtgatctacgactccaagttcgagaagcagctcggccaggtgatgctgctggtcctctgcgccgtgcagctgctgctcatgcgcaccagctgggccctgtgcgaggccctgaccctcgcgaccggccccatcacgaccctgtgggagggctccccggggaagttctggaacaccaccatcgccgtgagcatggccaacatcttccggggctcctacctggccggggcgggcctcgccttcagcatcatgaagtccgtcgggacgggccgccggggcaccgggagccagggcgagaccctgggggagaagtggaagaagaagctgaaccagctcagccgcaaggagttcgacctgtacaagaagtccggcatcaccgaggtggaccggaccgaggccaaggaggggctgaagcgcggcgagacgacccaccacgccgtgagccggggctccgccaagctccagtggttcgtcgagcgcaacatggtgatccccgaggggcgggtgatcgacctgggctgcgggcgcggcgggtggagctactactgcgcgggcctgaagaaggtcaccgaggtgcgcggctacaccaagggcgggcccgggcacgaggagcccgtgccgatgtccacgtacggctggaacatcgtcaagctcatgagcgggaaggacgtgttctacctgccgcccgagaagtgcgacaccctgctgtgcgacatcggcgagtccagcccctccccgaccgtggaggagagccggaccatccgcgtcctcaagatggtggagccctggctgaagaacaaccagttctgcatcaaggtgctgaacccctacatgcccacggtcatcgagcacctcgagcggctgcagcgcaagtacggcgggatgctggtgcggaacccgctctcccgcaacagcacccacgagatgtactggatctccaacggcaccgggaacatcgtgagctccgtcaacatggtgagccggctgctgctcaaccgcttcaccatgacgcaccggcgccccaccatcgagaaggacgtcgacctgggcgccggcacccggcacgtgaacgccgagcccgagaccccgaacatggacgtgatcggggagcgcatcaagcggatcaaggaggagcactccagcacgtggcactacgacgacgagaacccctacaagacctgggcctaccacggctcctacgaggtcaaggccaccgggagcgcgagctccatgatcaacggcgtggtgaagctgctcaccaagccctgggacgtcgtgcccatggtgacgcagatggccatgaccgacaccaccccgttcgggcagcagcgcgtcttcaaggagaaggtggacacgcggacgccccggcccatgcccggcacccggaaggtgatggagatcaccgccgagtggctgtggcgcacgctgggccggaacaagaagccgcgcctctgcacccgcgaggagttcaccaagaaggtccggaccaacgccgccatgggggcggtgttcacggaggagaaccagtgggacagcgcccgcgccgccgtggaggacgaggagttctggaagctggtcgaccgggagcgcgagctgcacaagctcggcaagtgcgggtcctgcgtgtacaacatgatgggcaagcgggagaagaagctgggggagttcggcaaggcgaagggcagccgcgccatctggtacatgtggctgggggcccggtacctcgagttcgaggccctgggcttcctgaacgaggaccactggttctcccgcgagaacagctactccggggtggagggcgaggggctccacaagctgggctacatcctgcgggacatcagcaagatccccggcggggccatgtacgcggacgacaccgccggctgggacacccgcatcaccgaggacgacctccacaacgaggagaagatcacgcagcagatggaccccgagcaccggcagctggccaacgccatcttcaagctgacctaccagaacaaggtcgtgaaggtgcagcgccccaccccgaaggggaccgtcatggacatcatctcccggaaggaccagcgcggcagcggccaggtggggacctacggcctcaacacgttcaccaacatggaggcccagctggtgcggcagatggagggggagggcgtcctgtccaaggcggacctcgagaacccccacctcctggagaagaagatcacccagtggctcgagaccaagggggtggagcgcctgaagcggatggccatcagcggcgacgactgcgtggtcaagcccatcgacgaccgcttcgccaacgccctgctcgccctgaacgacatgggcaaggtgcggaaggacatcccccagtggcagccgtccaaggggtggcacgactggcagcaggtccccttctgcagccaccacttccacgagctgatcatgaaggacggccgcaagctcgtcgtgccctgccggccccaggacgagctgatcgggcgcgcgcgcatctcccagggcgccgggtggagcctgaaggagacggcctgcctcggcaaggcctacgcccagatgtggtccctgatgtacttccaccggcgcgacctgcggctcgcgagcaacgccatctgctccgccgtgccggtccactggatccccaccagccgcaccacctggagcatccacgcccaccaccagtggatgacgaccgaggacatgctgaccgtgtggaaccgggtgtggatcgaggacaacccctggatggaggacaagacccccgtcacgacctgggaggacgtgccgtacctgggcaagcgcgaggaccagtggtgcgggtccctcatcggcctgaccagccgggcgacctgggcccagaacatcctgacggccatccagcaggtccgctccctcatcggggacgaggagttcctggactacatgcccagcatgaagcggttccgcaaggaggaggagtccgagggcgccatctggtga

SEQ ID NO: 10333 - RNA, 9873 nt, synthetic construct
  misc_feature 1..9873: note = derived and/or modified CDS sequence (opt1) from DENV-3__JQ045689__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcagttcgagaaggtggagacgtgggccctccgccacccggggttcaccatcctggcgctgttcctcgcccactacatcggcacctccctgacccagaaggtcgtgatcttcatcctgctcatgctggtgacgcccagcatgaccatgcggtgcgtcggggtgggcaaccgcgacttcgtggagggcctgtccggggccacctgggtcgacgtggtgctcgagcacggcgggtgcgtcaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtggaccgggggtggggcaacgggtgcggcctgttcgggaagggctccctggtgacctgcgccaagttccagtgcctcgagcccatcgagggcaaggtggtgcagtacgagaacctgaagtacaccgtcatcatcacggtgcacaccggggaccagcaccaggtgggcaacgacacccagggggtcaccgtggagatcacgccccaggccagcaccgtcgaggccgtgctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtgtccgagacccagcacgggacgatcctgatcaaggtcgagtacaagggcgaggacgccccgtgcaagatccccttcagcaccgaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacctggatcggcctgaacagcaagaacacgtccatgagcttctcctgcatcgtgatcgggatcatcaccctgtacctcggcgccgtggtccaggccgacatggggtgcgccatcaactggaagggcaaggagctgaagtgcggcagcgggatcttcgtgaccaacgaggtgcacacctggacggagcagtacaagttccaggcggactcccccaagcgcctggccaccgccatcgccggcgcctgggagaacggggtctgcggcatccgcagcaccacccggatggagaacctcctgtggaagcagatcgcgaacgagctgaactacatcctctgggagaacaacatcaagctgacggtggtggtcggggacatcatcggcgtgctggagcagggcaagcgcaccctcacgccccagccgatggagctgaagtactcctggaagacctgggggaaggccaagatcgtgacggccgagacccagaacagctccttcatcatcgacggccccaacacccccgagtgccccagcgcctcccgggcgtggaacgtctgggaggtggaggactacgggttcggcgtgttcaccacgaacatctggctgaagctccgcgaggtctacacccagagctgcgaccaccggctgatgagcgccgccatcaaggacgagcgcgccgtgcacgccgacatgggctactggatcgagtcccagaagaacgggagctggaagctggagaaggcgtccttcatcgaggtgaagacctgcacctggcccaagagccacaccctctggtccaacggcgtcctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtgatcacggagaactgcgggacccgcggcccctccctccggaccaccacggtcagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcctgttcaccttcgtgctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtcggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgccgctcctggcccctcaacgagggggtgatggccgtgggcctggtcagcatcctggcctccagcctcctgcggaacgacgtgcccatggccggcccgctggtggccggcgggctcctgatcgcctgctacgtcatcacggggacctccgccgacctgaccgtggagaaggccgccgacgtgacctgggaggaggaggcggagcagacgggggtcagccacaacctcatgatcaccgtggacgacgacgggaccatgcgcatcaaggacgacgagaccgagaacatcctgaccgtgctgctcaagacggccctgctgatcgtctccggcatcttcccctacagcatccccgccaccctcctggtgtggcacacctggcagaagcagacccagcggtccggcgtgctgtgggacgtccccagcccgcccgagacgcagaaggccgagctcgaggagggggtgtaccgcatcaagcagcagggcatcttcgggaagacccaggtgggcgtcggggtgcagaaggagggcgtgttccacaccatgtggcacgtcacccggggcgccgtgctgacgcacaacgggaagcgcctggagcccaactgggcgtccgtgaagaaggacctcatcagctacggcgggggctggcggctgtccgcccagtggcagaagggggaggaggtccaggtgatcgccgtggagcccggcaagaacccgaagaacttccagaccatgcccggcatcttccagaccaccacgggggagatcggcgccatcgcgctggacttcaagcccgggaccagcggcagcccgatcatcaaccgcgagggcaaggtcgtggggctgtacggcaacggggtggtcaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcgcccacgcgggtcgtggccgccgagatggaggaggccctgaaggggctgcccatccgctaccagaccaccgccaccaagtccgagcacacgggccgggagatcgtggacctcatgtgccacgcgaccttcaccatgcgcctgctgagcccggtccgggtgcccaactacaacctcatcatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgcgaacttcaaggccgaccgcgtcatcgacccccggcgctgcctgaagcccgtgatcctgaccgacggccccgagcgggtgatcctcgccgggccgatgcccgtcacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtggagctcatgcggcgcggggacctgcccgtctggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgcaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccgggggcgccatgctgttcctgatcagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtcagccgcggctccgccaagctccagtggttcgtggagcggaacatggtgacccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacgtacggctggaacatcgtgaagctcatgagcgggaaggacgtgttctacctgccgcccgagaagtgcgacaccctgctgtgcgacatcggcgagtccagcccctccccgaccgtcgaggagagccgcaccatccgggtgctcaagatggtggagccctggctgaagaacaaccagttctgcatcaaggtcctgaacccctacatgcccacggtgatcgagcacctcgagcgcctgcagcggaagtacggcgggatgctggtgcgcaacccgctctcccggaacagcacccacgagatgtactggatctccaacggcaccgggaacatcgtcagctccgtgaacatggtgagccgcctgctgctcaaccggttcaccatgacgcaccgccggcccaccatcgagaaggacgtcgacctgggcgccggcacccgccacgtgaacgccgagcccgagaccccgaacatggacgtcatcggggagcggatcaagcgcatcaaggaggagcactccagcacgtggcactacgacgacgagaacccctacaagacctgggcctaccacggctcctacgaggtgaaggccaccgggagcgcgagctccatgatcaacggcgtggtcaagctgctcaccaagccctgggacgtggtgcccatggtcacgcagatggccatgaccgacaccaccccgttcgggcagcagcgggtgttcaaggagaaggtggacacgcgcacgccccggcccatgcccggcacccgcaaggtcatggagatcaccgccgagtggctgtggcggacgctgggccgcaacaagaagccgcgcctctgcacccgggaggagttcaccaagaaggtgcgcaccaacgccgccatgggggcggtgttcacggaggagaaccagtgggacagcgcccgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgcggacgacaccgccggctgggacacccggatcaccgaggacgacctccacaacgaggagaagatcacgcagcagatggaccccgagcaccgccagctggccaacgccatcttcaagctgacctaccagaacaaggtggtgaaggtccagcggcccaccccgaaggggaccgtgatggacatcatctcccgcaaggaccagcggggcagcggccaggtggggacctacggcctcaacacgttcaccaacatggaggcccagctggtccgccagatggagggggagggcgtgctgtccaaggcggacctcgagaacccccacctcctggagaagaagatcacccagtggctcgagaccaagggggtggagcggctgaagcgcatggccatcagcggcgacgactgcgtcgtgaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtggtgccctgccgcccccaggacgagctgatcgggcgcgcgcggatctcccagggcgccgggtggagcctgaaggagacggcctgcctcggcaaggcctacgcccagatgtggtccctgatgtacttccaccgccgggacctgcgcctcgcgagcaacgccatctgctccgccgtcccggtgcactggatccccaccagccggaccacctggagcatccacgcccaccaccagtggatgacgaccgaggacatgctgaccgtgtggaaccgcgtctggatcgaggacaacccctggatggaggacaagacccccgtgacgacctgggaggacatcccgtacctgggcaagcgggaggaccagtggtgcgggtccctcatcggcctgaccagccgcgcgacctgggcccagaacatcctgacggccatccagcaggtccggtccctcatcggggacgaggagttcctggactacatgcccagcatgaagcgcttccggaaggaggaggagtccgagggcgccatctggtga

SEQ ID NO: 10334 - RNA, 9873 nt, synthetic construct
  misc_feature 1..9873: note = derived and/or modified CDS sequence (opt1) from DENV-3__JQ045691__SS-prME
  source 1..9873: mol_type = other RNA
accagcctgtgcctcatgatgatgctgcccgcgaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacatcggcatggggctggacacccgcacccagacctggatgagcgccgagggcgcctggcggcaggtcgagaaggtggagacgtgggccctccgccacccggggttcaccatcctggcgctgttcctcgcccactacatcggcacctccctgacccagaaggtcgtgatcttcatcctgctcatgctggtgacgcccagcatgaccatgcggtgcgtcggggtgggcaaccgcgacttcgtggagggcctgtccggggccacctgggtcgacgtggtgctcgagcacggcgggtgcgtcaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtggaccgggggtggggcaacgggtgcggcctgttcgggaagggctccctggtgacctgcgccaagttccagtgcctcgagcccatcgagggcaaggtggtgcagtacgagaacctgaagtacaccgtcatcatcacggtgcacaccggggaccagcaccaggtgggcaacgacacccagggggtcaccgtggagatcacgccccaggccagcaccgtcgaggccatcctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaaccgcaaggagctgctggtgaccttcaagaacgcccacgccaagaagcaggaggtcgtggtgctcgggtcccaggagggcgccatgcacaccgcgctgaccggggccacggagatccagatcagcggcgggacctccatcttcgccggccacctgaagtgccggctcaagatggacaagctggagctgaagggcatgagctacgccatgtgcctcaacaccttcgtcctgaagaaggaggtgtccgagacccagcacgggacgatcctgatcaaggtggagtacaagggcgaggacgccccgtgcaagatccccttcagcaccgaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaaggccctcaagatcaactggtacaagaagggctccagcatcgggaagatgttcgaggcgacggcccggggcgcccgccggatggccatcctgggcgacaccgcctgggacttcgggtccgtgggcggggtgctgaacagcctcggcaagatggtccaccagatcttcgggtccgcgtacaccgccctgttcagcggcgtgtcctggatcatgaagatcggcatcggggtgctgctcacctggatcggcctgaacagcaagaacacgtccatgagcttctcctgcatcgtcatcgggatcatcaccctgtacctcggcgccgtggtgcaggccgacatggggtgcgccatcaactggaagggcaaggagctgaagtgcggcagcgggatcttcgtcaccaacgaggtgcacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtcgtggtgggggacatcatcggcgtcctggagcagggcaagcgcaccctcacgccccagccgatggagctgaagtactcctggaagacctgggggaaggccaagatcgtgacggccgagacccagaacagctccttcatcatcgacggccccaacacccccgagtgccccagcgcctcccgggcgtggaacgtgtgggaggtcgaggactacgggttcggcgtgttcaccacgaacatctggctgaagctccgcgaggtgtacacccagagctgcgaccaccggctgatgagcgccgccatcaaggacgagcgcgccgtccacgccgacatgggctactggatcgagtcccagaagaacgggagctggaagctggagaaggcgtccttcatcgaggtgaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtcgtgatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcaccttcgtcctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgctccaacacgatcttcaccctgaccgtggcctggcgcaccgccacgctcatcctggccggggtgagcctgctcccgctgtgccagtccagctccatgcggaagaccgactggctgcccatgaccgtcgcggccatgggcgtgccgcccctcccgctgttcatcttcagcctgaaggacacccccaagaagcgctcctggcccctcaacgagggggtcatggccgtgggcctggtgagcatcctggcctccagcctcctgcgcaacgacgtccccatggccggcccgctggtggccggcgggctcctgatcgcctgctacgtgatcacggggacctccgccgacctgaccgtcgagaaggccgccgacgtgacctgggaggaggaggcggagcagacgggggtgagccacaacctcatgatcaccgtcgacgacgacgggaccatgcggatcaaggacgacgagaccgagaacatcctgaccgtgctgctcaagacggccctgctgatcgtgtccggcatcttcccctacagcatccccgccaccctcctggtctggcacacctggcagaagcagacccagcgctccggcgtgctgtgggacgtgcccagcccgcccgagacgcagaaggccgagctcgaggagggggtctaccggatcaagcagcagggcatcttcgggaagacccaggtgggcgtgggggtccagaaggagggcgtgttccacaccatgtggcacgtgacccgcggcgccgtcctgacgcacaacgggaagcggctggagcccaactgggcgtccgtgaagaaggacctcatcagctacggcgggggctggcgcctgtccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgggagggcaaggtggtcgggctgtacggcaacggggtggtgaccaagaacggcgggtacgtctccggcatcgcccagaccaacgccgagcccgacggccccacgcccgagctcgaggaggagatgttcaagaagcgcaacctgaccatcatggacctgcacccggggagcggcaagacccggaagtacctccccgccatcgtgcgcgaggccatcaagcggcgcctgcggaccctgatcctcgcgcccacgcgcgtggtcgccgccgagatggaggaggccctgaaggggctgcccatccggtaccagaccaccgccaccaagtccgagcacacgggccgcgagatcgtggacctcatgtgccacgcgaccttcaccatgcggctgctgagcccggtgcgcgtccccaactacaacctcatcatcatggacgaggcccacttcaccgaccccgcctccatcgccgcccgggggtacatcagcacgcgcgtgggcatgggcgaggcggccgccatcttcatgaccgccacgccgcccgggaccgcggaggccttcccccagtccaacgcccccatccaggacgaggagcgggacatccccgagcgcagctggaactccggcaacgagtggatcacggacttcgtggggaagaccgtctggttcgtgcccagcatcaaggccggcaacgacatcgccaactgcctgcgcaagaacgggaagaaggtgatccagctgtcccggaagaccttcgacaccgagtaccagaagacgcgcctcaacgactgggacttcgtcgtgaccaccgacatcagcgagatgggcgcgaacttcaaggccgaccgggtgatcgacccccgccggtgcctgaagcccgtcatcctgaccgacggccccgagcgcgtgatcctcgccgggccgatgcccgtgacggccgcctccgcggcccagcggcgcggccgggtcgggcgcaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgggagaagtccgcggccatcgacggcgagtaccgcctgaagggcgagtcccggaagaccttcgtggagctcatgcgccgcggggacctgcccgtgtggctggcccacaaggtcgccagcgagggcatcaagtacacggaccgcaagtggtgcttcgacggggagcggaacaaccagatcctcgaggagaacatggacgtggagatctggaccaaggagggcgagcgcaagaagctgcggccgcgctggctggacgcgcgcacctactccgaccccctcgccctgaaggagttcaaggacttcgccgccggccgcaagagcatcgccctggacctcgtcaccgagatcgggcgcgtgccctcccacctggcgcaccggacgcgcaacgccctggacaacctcgtgatgctgcacaccagcgagcacggcgggcgggcctaccgccacgccgtcgaggagctgccggagaccatggagaccctcctgctgctcggcctgatgatcctgctcaccggcggggccatgctgttcctgctcagcgggaaggggatcggcaagacctccatcgggctgatctgcgtgatcgtgagctccggcatgctgtggatggcggacgtccccctccagtggatcgccagcgccatcgtgctggagttcttcatgatggtgctgctcatccccgagcccgagaagcagcggaccccgcaggacaaccagctggcctacgtcgtgatcgggatcctgaccctcgccgcgatcgtggccgccaacgagatgggcctgctggagacgaccaagcgcgacctcggcatgtccaaggagcccggggtcgtgagccccacctcctacctggacgtggacctgcaccccgccagcgcctggaccctctacgcggtcgccacgaccgtgatcaccccgatgctgcggcacaccatcgagaactccacggccaacgtgagcctggccgcgatcgccaaccaggccgtcgtgctcatgggcctggacaaggggtggcccatctccaagatggacctgggcgtgcccctcctggccctggggtgctacagccaggtcaaccccctcaccctgaccgccgcggtgctgctcctggtgacccactacgccatcatcggcccgggcctgcaggccaaggccacgcgcgaggcccagaagcggaccgcggccgggatcatgaagaaccccaccgtcgacggcatcatgaccatcgacctcgaccccgtgatctacgactccaagttcgagaagcagctgggccaggtgatgctgctcgtcctgtgcgccgtgcagctgctcctgatgcgcacgagctgggccctgtgcgaggccctcaccctggcgaccggccccatcaccacgctgtgggagggctccccggggaagttctggaacaccaccatcgccgtgagcatggccaacatcttccggggctcctacctcgccggggcgggcctggccttcagcatcatgaagtccgtcgggaccggccgccggggcacggggagccagggcgagaccctgggggagaagtggaagaagaagctcaaccagctgagccgcaaggagttcgacctgtacaagaagtccggcatcaccgaggtggaccggaccgaggccaaggaggggctcaagcgcggcgagaccacgcaccacgccgtgagccggggctccgccaagctgcagtggttcgtcgagcgcaacatggtgatccccgaggggcgggtgatcgacctgggctgcgggcgcggcgggtggagctactactgcgcgggcctcaagaaggtcaccgaggtgcgcggctacaccaagggcggccccgggcacgaggagcccgtgccgatgtccacctacggctggaacctggtcaagctgatgagcgggaaggacgtgttctacctgccgcccgagaagtgcgacacgctcctgtgcgacatcggcgagtccagcccctccagcaccgtggaggagtcccggaccatccgcgtcctgaagatggtggagccgtggctcaagaacaaccagttctgcatcaaggtgctgaacccctacatgcccaccgtcatcgagcacctggagcggctccagcgcaagtacggcgggatgctggtgcggaaccccctgagccgcaactccacgcacgagatgtactggatcagcaacggcaccgggaacatcgtgtccagcgtcaacatggtgtcccggctcctgctgaaccgcttcaccatgacccaccggcgcccgacgatcgagaaggacgtggacctcggcgccggcacccggcacgtcaacgccgagcccgagacccccaacatggacgtgatcggggagcgcatcaagcggatcaaggaggagcacagctccacctggcactacgacgacgagaacccgtacaagacgtgggcctaccacggcagctacgaggtcaaggccaccgggagcgcgtccagcatgatcaacggcgtggtgaagctgctgaccaagccctgggacgtcgtgcccatggtgacccagatggccatgacggacaccacccccttcgggcagcagcgcgtcttcaaggagaaggtggacacccggacgccgcgcgccatgcccggcacccggaaggtgatggagatcaccgccgagtggctctggcgcaccctgggccggaacaagaagccccgcctgtgcacgcgcgaggagttcaccaagaaggtccggaccaacgccgcgatgggggccgtgttcaccgaggagaaccagtgggactccgcccgcgccgcggtggaggacgaggagttctggaagctcgtcgaccgggagcgcgagctgcacaagctgggcaagtgcgggagctgcgtgtacaacatgatgggcaagcgggagaagaagctcggggagttcggcaaggccaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatccccggcggggcgatgtacgccgacgacacggccggctgggacacccgcatcaccgaggacgacctgcacaacgaggagaagatcacccagcagatggacccggagcaccggcagctcgccaacgccatcttcaagctgacgtaccagaacaaggtcgtgaaggtgcagcgccccacccccaaggggaccgtcatggacatcatcagccggaaggaccagcgcggctccggccaggtggggacctacggcctgaacaccttcacgaacatggaggcgcagctcgtgcggcagatggagggggagggcgtcctgagcaaggccgacctggagaactcccacctcctggagaagaagatcacccagtggctggagaccaagggggtggagcgcctcaagcggatggccatcagcggcgacgactgcgtggtcaagcccatcgacgaccgcttcgccaacgccctgctggcgctcaacgacatgggcaaggtgcggaaggacatcccgcagtggcagccctccaaggggtggcacgactggcagcaggtccccttctgcagccaccacttccacgagctgatcatgaaggacggccgcaagctggtcgtgccctgccggccgcaggacgagctcatcgggcgcgcccgcatctcccagggcgccgggtggagcctgaaggagaccgcctgcctgggcaaggcctacgcgcagatgtggtccctcatgtacttccaccggcgcgacctgcggctggccagcaacgccatctgcagcgccgtgcccgtccactggatccccacgtcccgcaccacctggagcatccacgcgcaccaccagtggatgaccacggaggacatgctcaccgtgtggaaccgggtgtggatcgaggacaacccctggatggaggacaagaccccggtcaccacgtgggaggacgtgccctacctgggcaagcgcgaggaccagtggtgcgggtccctgatcggcctcaccagccgggccacctgggcccagaacatcctgaccgccatccagcaggtccgctccctgatcggggacgaggagttcctcgactacatgcccagcatgaagcggttccgcaaggaggaggagtccgagggcgccatctggtga

SEQ ID NO: 10335 - RNA, 9873 nt, synthetic construct
  misc_feature 1..9873: note = derived and/or modified CDS sequence (opt1) from DENV-3__JQ045692__SS-prME
  source 1..9873: mol_type = other RNA
accagcctgtgcctcatgatgatgctgcccgcgaccctggccttccacctcaccagccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtcgagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccatcctgcccgagtacggcaccctcgggctggagtgctccccgcgcaccggcctggacttcaacgagatgatcctcctgaccatgaagaacaaggcgtggatggtgcaccggcagtggttcttcgacctgcccctcccctggacgagcggcgccaccaccgagacccccacgtggaaccgcaaggagctgctggtcaccttcaagaacgcccacgccaagaagcaggaggtggtggtcctcgggtcccaggagggcgccatgcacaccgcgctgaccggggccacggagatccagatcagcggcgggacctccatcttcgccggccacctgaagtgccggctcaagatggacaagctggagctgaagggcatgagctacgccatgtgcctcaacaccttcgtgctgaagaaggaggtgtccgagacccagcacgggacgatcctgatcaaggtcgagtacaagggcgaggacgccccgtgcaagatccccttcagcaccgaggacgggcagggcaaggcgcacaacggccgcctgatcaccgccaaccccgtggtgaccaagaaggaggagcccgtcaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtgggcggggtcctgaacagcctcggcaagatggtgcaccagatcttcgggtccgcgtacaccgccctgttcagcggcgtgtcctggatcatgaagatcggcatcggggtcctgctcacctggatcggcctgaacagcaagaacacgtccatgagcttctcctgcatcgtgatcgggatcatcaccctgtacctcggcgccgtggtccaggccgacatggggtgcgccatcaactggaagggcaaggagctgaagtgcggcagcgggatcttcgtgaccaacgaggtgcacacctggacggagcagtacaagttccaggcggactcccccaagcgcctggccaccgccatcgccggcgcctgggagaacggggtctgcggcatccgcagcaccacccggatggagaacctcctgtggaagcagatcgcgaacgagctgaactacatcctctgggagaacaacatcaagctgacggtggtggtcggggacatcatcggcgtgctggagcagggcaagcgcaccctcacgccccagccgatggagctgaagtactcctggaagacctgggggaaggccaagatcgtgacggccgagacccagaacagctccttcatcatcgacggccccaacacccccgagtgccccagcgcctcccgggcgtggaacgtctgggaggtggaggactacgggttcggcgtgttcaccacgaacatctggctgaagctccgcgaggtctacacccagagctgcgaccaccggctgatgagcgccgccatcaaggacgagcgcgccgtgcacgccgacatgggctactggatcgagtcccagaagaacgggagctggaagctggagaaggcgtccttcatcgaggtgaagacctgcacctggcccaagagccacaccctctggtccaacggcgtcctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtgatcacggagaactgcgggacccgcggcccctccctccggaccaccacggtcagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtcgacaacttcaccatgggcgtgctgtgcctcgccatcctgttcgaggaggtgatgcgggggaagttcggcaagaagcacatgatcgcgggggtcctgttcaccttcgtgctcctgctgtccggccagatcacgtggcgcgacatggcccacaccctcatcatgatcggcagcaacgcctccgaccggatggggatgggcgtgacctacctggccctgatcgccaccttcaagatccagcccttcctcgcgctggggttcttcctgcgcaagctcacgagccgggagaacctgctgctcggcgtcggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctcccgctgttcatcttcagcctgaaggacacccccaagcgccgctcctggcccctcaacgagggggtgatggccgtgggcctggtcagcatcctggcctccagcctcctgcggaacgacgtgcccatggccggcccgctggtggccggcgggctcctgatcgcctgctacgtcatcacggggacctccgccgacctgaccgtggagaaggccgccgacgtgacctgggaggaggaggcggagcagacgggggtcagccacaacctcatgatcaccgtggacgacgacgggaccatgcgcatcaaggacgacgagaccgagaacatcctgaccgtgctgctcaagacggccctgctgatcgtctccggcatcttcccctacagcatccccgccaccctcctggtgtggcacacctggcagaagcagacccagcggtccggcgtgctgtgggacgtccccagcccgcccgaggcccagaaggccgagctcgaggagggggtgtaccgcatcaagcagcagggcatcttcgggaagacccaggtgggcgtcggggtgcagaaggagggcgtgttccacaccatgtggcacgtcacccggggcgcggtgctgacccacaacgggaagcgcctggagcccaactgggcctccgtgaagaaggacctcatcagctacggcgggggctggcggctgtccgcccagtggcagaagggggaggaggtccaggtgatcgccgtggagcccggcaagaacccgaagaacttccagacgatgcccggcatcttccagaccaccaccggggagatcggcgcgatcgccctggacttcaagcccgggacgagcggcagcccgatcatcaaccgcgagggcaaggtcgtggggctgtacggcaacggggtggtcaccaagaacggcgggtacgtgtccggcatcgcccagaccaacgccgagcccgacggccccacccccgagctcgaggaggagatgttcaagaagcggaacctgacgatcatggacctgcacccggggagcggcaagacccgcaagtacctccccgccatcgtgcgggaggcgatcaagcgccggctgcgcaccctgatcctcgcccccacccgggtcgtggccgccgagatggaggaggccctgaaggggctgcccatccgctaccagacgaccgcgaccaagtccgagcacaccggccgggagatcgtggacctcatgtgccacgccacgttcaccatgcgcctgctgagcccggtccgggtgcccaactacaacctcatcatcatggacgaggcccacttcaccgaccccgcctccatcgccgcgcgcgggtacatcagcacccgggtgggcatgggcgaggccgccgccatcttcatgacggcgacgccgcccgggaccgccgaggccttcccccagtccaacgcccccatccaggacgaggagcgcgacatccccgagcgcagctggaactccggcaacgagtggatcaccgacttcgtcgggaagacggtgtggttcgtgcccagcatcaaggccggcaacgacatcgcgaactgcctgcggaagaacgggaagaaggtcatccagctgtcccgcaagaccttcgacaccgagtaccagaagacccggctcaacgactgggacttcgtggtgacgaccgacatcagcgagatgggcgccaacttcaaggccgaccgcgtcatcgacccccggcgctgcctgaagcccgtgatcctgaccgacggccccgagcgggtgatcctcgccgggccgatgcccgtcaccgccgcgtccgccgcccagcgccggggccgcgtggggcggaacccccagaaggagaacgaccagtacatcttcacgggccagcccctgaacaacgacgaggaccacgcccactggaccgaggccaagatgctgctcgacaacatcaacaccccggaggggatcatccccgcgctgttcgagcccgagcgcgagaagtccgccgccatcgacggcgagtaccggctgaagggcgagtcccgcaagaccttcgtggagctcatgcggcgcggggacctgcccgtctggctggcccacaaggtggcgagcgagggcatcaagtacaccgaccggaagtggtgcttcgacggggagcgcaacaaccagatcctcgaggagaacatggacgtcgagatctggacgaaggagggcgagcggaagaagctgcgcccgcgctggctggacgcccggacctactccgaccccctcgccctgaaggagttcaaggacttcgccgccggccgcaagagcatcgcgctggacctcgtgaccgagatcgggcgggtgccctcccacctggcccaccgcacccggaacgccctggacaacctcgtcatgctgcacacgagcgagcacggcgggcgcgcctaccggcacgccgtggaggagctgccggagaccatggagaccttcctcctgctgggcctcatgatcctgctgaccgggggcgcgatgctgttcctgctgagcggcaaggggatcggcaagacgtccatcgggctcatctgcgtgatcgtcagctccggcatgctgtggatggccgacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggcggccatcgtcgccgccaacgagatgggcctcctggagaccacgaagcgggacctgggcatgtccaaggagcccggggtggtgagccccacctcctacctcgacgtcgacctgcaccccgccagcgcgtggaccctgtacgccgtggccaccacggtgatcaccccgatgctccgccacaccatcgagaactccaccgccaacgtcagcctggcggccatcgccaaccaggccgtggtgctgatgggcctcgacaaggggtggcccatctccaagatggacctgggcgtccccctgctcgccctggggtgctacagccaggtgaaccccctgacgctcaccgcggccgtgctgctgctcgtcacccactacgccatcatcggcccgggcctgcaggccaaggccacccgggaggcgcagaagcgcacggccgccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggaccagctgggccctgtgcgaggcgctgacgctcgccaccggccccatcaccaccctgtgggagggctccccggggaagttctggaacacgaccatcgccgtcagcatggccaacatcttccgcggctcctacctggcgggggccggcctcgccttcagcatcatgaagtccgtggggaccggccggcgcggcaccgggagccagggcgagacgctgggggagaagtggaagaagaagctgaaccagctcagccggaaggagttcgacctgtacaagaagtccggcatcaccgaggtggaccgcaccgaggccaaggaggggctgaagcggggcgagaccacccaccacgccgtcagccgcggctccgcgaagctccagtggttcgtggagcggaacatggtgatccccgaggggcgcgtcatcgacctgggctgcgggcgcggcgggtggagctactactgcgccggcctgaagaaggtgacggaggtgcggggctacaccaagggcggccccgggcacgaggagcccgtcccgatgtccacctacggctggaacctcgtgaagctgatgagcgggaaggacgtgttctacctgccgcccgagaagtgcgacaccctgctctgcgacatcggcgagtccagcccctccagcacggtcgaggagtcccgcaccatccgggtgctgaagatggtggagccgtggctgaagaacaaccagttctgcatcaaggtcctcaacccctacatgcccaccgtgatcgagcacctggagcgcctgcagcggaagtacggcgggatgctcgtgcgcaaccccctgagccggaactccacccacgagatgtactggatcagcaacggcacggggaacatcgtctccagcgtgaacatggtgtcccgcctgctcctgaaccggttcaccatgacccaccgccggccgaccatcgagaaggacgtcgacctgggcgccggcacgcgccacgtgaacgccgagcccgagacccccaacatggacgtcatcggggagcggatcaagcgcatcaaggaggagcacagctccacctggcactacgacgacgagaacccgtacaagacctgggcctaccacggcagctacgaggtgaaggcgacggggagcgcctccagcatgatcaacggcgtggtcaagctcctgaccaagccctgggacgtggtgcccatggtcacccagatggccatgaccgacacgacccccttcgggcagcagcgggtgttcaaggagaaggtggacacccgcaccccgcgggccatgcccggcacgcgcaaggtcatggagatcaccgccgagtggctgtggcggaccctcggccgcaacaagaagccccgcctgtgcacccgggaggagttcacgaagaaggtgcgcaccaacgcggccatgggggccgtgttcaccgaggagaaccagtgggactccgcccgggcggccgtcgaggacgaggagttctggaagctggtggaccgcgagcgggagctccacaagctgggcaagtgcgggagctgcgtgtacaacatgatgggcaagcgcgagaagaagctgggggagttcggcaaggccaagggctcccgggccatctggtacatgtggctcggggcccgctacctggagttcgaggcgctgggcttcctcaacgaggaccactggttcagccgggagaactcctacagcggggtcgagggcgaggggctgcacaagctgggctacatcctccgcgacatctccaagatccccggcggggccatgtacgccgacgacaccgccggctgggacacgcggatcaccgaggacgacctgcacaacgaggagaagatcacccagcagatggacccggagcaccgccagctggccaacgcgatcttcaagctcacctaccagaacaaggtggtgaaggtccagcggcccacgcccaaggggaccgtgatggacatcatcagccgcaaggaccagcggggctccggccaggtggggacctacggcctgaacaccttcaccaacatggaggcccagctggtccgccagatggagggggagggcgtgctcagcaaggccgacctggagaacccccacctcctcgagaagaagatcacgcagtggctggagaccaagggggtggagcggctgaagcgcatggccatctccggcgacgactgcgtcgtgaagccgatcgacgaccggttcgccaacgcgctcctggccctgaacgacatgggcaaggtgcgcaaggacatcccccagtggcagcccagcaaggggtggcacgactggcagcaggtccccttctgctcccaccacttccacgagctcatcatgaaggacggccggaagctggtggtgccgtgccgcccccaggacgagctgatcgggcgcgcccggatcagccagggcgccgggtggtccctcaaggagaccgcctgcctgggcaaggcgtacgcccagatgtggagcctgatgtacttccaccgccgggacctccgcctggcctccaacgccatctgcagcgcggtccccgtgcactggatccccaccagccggacgacctggtccatccacgcccaccaccagtggatgaccaccgaggacatgctgacggtgtggaaccgcgtctggatcgaggacaacccgtggatggaggacaagacccccgtgaccacctgggaggacgtgccctacctcggcaagcgggaggaccagtggtgcgggagcctgatcggcctgacgtcccgcgccacctgggcccagaacatcctcaccgccatccagcaggtccggagcctgatcggggacgaggagttcctggactacatgccctccatgaagcgcttccggaaggaggaggagagcgagggcgcgatctggtga

SEQ ID NO: 10336 - RNA, 9873 nt, synthetic construct
  misc_feature 1..9873: note = derived and/or modified CDS sequence (opt1) from DENV-3__JQ045694__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgagcgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgccatcaactggaagggcaaggagctgaagtgcggcagcgggatcttcgtgaccaacgaggtccacacctggacggagcagtacaagttccaggcggactcccccaagcgcctggccaccgccatcgccggcgcctgggagaacggggtgtgcggcatccgcagcaccacccggatggagaacctcctgtggaagcagatcgcgaacgagctgaactacatcctctgggagaacaacatcaagctgacggtggtcgtgggggacatcatcggcgtgctggagcagggcaagcgcaccctcacgccccagccgatggagctgaagtactcctggaagacctgggggaaggccaagatcgtcacggccgagacccagaacagctccttcatcatcgacggccccaacacccccgagtgccccagcgcctcccgggcgtggaacgtgtgggaggtggaggactacgggttcggcgtcttcaccacgaacatctggctgaagctccgcgaggtgtacacccagagctgcgaccaccggctgatgagcgccgccatcaaggacgagcgcgccgtgcacgccgacatgggctactggatcgagtcccagaagaacgggagctggaagctggagaaggcgtccttcatcgaggtcaagacctgcacctggcccaagagccacaccctctggtccaacggcgtgctggagagcgacatgatcatccccaagtccctggccgggcccatcagccagcacaaccaccggccgggctaccacacgcagaccgccgggccctggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccacaccctcatcatgatcggcagcaacgcctccgaccggatggggatgggcgtcacctacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtgagcctgacctgctccaacacgatcttcaccctgaccgtcgcctggcgcaccgccacgctcatcctggccggggtgagcctgctcccgctgtgccagtccagctccatgcggaagaccgactggctgcccatgaccgtcgcggccatgggcgtgccgcccctgccgctgttcatcttcagcctgaaggacacccccaagcgccgctcctggcccctcaacgagggggtgatggccgtcggcctggtgagcatcctggcctccagcctcctgcggaacgacgtgcccatggccggcccgctggtcgccggcgggctcctgatcgcctgctacgtgatcacggggacctccgccgacctgaccgtggagaaggccgccgacgtcacctgggaggaggaggcggagcagacgggggtgagccacaacctcatgatcaccgtggacgacgacgggaccatgcgcatcaaggacgacgagaccgagaacatcctgaccgtcctgctcaagacggccctgctgatcgtgtccggcatcttcccctacagcatccccgccaccctcctggtgtggcacacctggcagaagcagacccagcggtccggcgtcctgtgggacgtgcccagcccgcccgagacgcagaaggccgagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagcccaactgggcgtccgtcaagaaggacctcatcagctacggcgggggctggcggctgtccgcccagtggcagaagggggaggaggtccaggtgatcgccgtcgagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtggggctgtacggcaacggggtcgtgaccaagaacggcgggtacgtgtccggcatcgcccagaccaacgccgagcccgacggccccacgcccgagctcgaggaggagatgttcaagaagcggaacctgaccatcatggacctgcacccggggagcggcaagacccgcaagtacctccccgccatcgtccgggaggccatcaagcgccggctgcgcaccctgatcctcgcgcccacgcgggtggtggccgccgagatggaggaggccctgaaggggctgcccatccgctaccagaccaccgccaccaagtccgagcacacgggccgggagatcgtcgacctcatgtgccacgcgaccttcaccatgcgcctgctgagcccgatccgggtgcccaactacaacctcatcatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgcgaacttcaaggccgaccgcgtcatcgacccccggcgctgcctgaagcccgtgatcctgaccgacggccccgagcgggtgatcctcgccgggccgatgcccgtcacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtggagctcatgcggcgcggggacctgcccgtctggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgtaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccgggggcgccatgctgttcctgatgagcggcaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggccccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtctcccgcggcagcgccaagctccagtggttcgtggagcggaacatggtgatccccgaggggcgcgtcatcgacctgggctgcgggcgcggcgggtggtcctactactgcgcgggcctgaagaaggtgaccgaggtgcggggctacaccaagggcggccccgggcacgaggagccggtccccatgagcacctacggctggaacctcgtgaagctgatgtccgggcgcgacgtgttctacctgccgcccgagaagtgcgacacgctgctctgcgacatcggcgagagctccccgagccccaccgtcgaggagtcccggaccatccgcgtgctgaagatggtggagccctggctgaagaacaaccagttctgcatcaaggtcctcaacccctacatgccgaccgtgatcgagcacctggagcggctgcagcgcaagtacggcgggatgctcgtgcggaaccccctgagccgcaactccacgcacgagatgtactggatcagcaacggcaccgggaacatcgtctccagcgtgaacatggtgtcccggctgctcctgaaccgcttcaccatgacccaccggcgccccacgatcgagaaggacgtcgacctgggcgccggcacccggcacgtgaacgccgagccggagacccccaacatggacgtcatcggggagcgcatcaagcggatcaaggaggagcacagctccacctggcactacgacgacgagaacccctacaagacgtgggcctaccacggcagctacgaggtgaaggccaccgggtccgcgagcagcatgatcaacggcgtggtcaagctcctgaccaagccctgggacgtggtgccgatggtcacccagatggccatgacggacaccacccccttcgggcagcagcgcgtgttcaaggagaaggtggacacccggacgccccgccccatgccgggcacccggaaggtcatggagatcaccgccgagtggctgtggcgcaccctcggccgcaacaagaagccccggctgtgcacgcgcgaggagttcaccaagaaggtgcggaccaacgccgccatgggggcggtgttcaccgaggagaaccagtgggactccgcccgcgccgccgtcgaggacgaggagttctggaagctggtggaccgggagcgcgagctccacaagctgggcaagtgcgggagctgcgtgtacaacatgatgggcaagcgggagaagaagctgggggagttcggcaaggcgaagggctcccgcgccatctggtacatgtggctcggggcccggtacctggagttcgaggccctgggcttcctcaacgaggaccactggttcagccgcgagaactcctacagcggggtcgagggcgaggggctgcacaagctgggctacatcctccgggacatctccaagatccccggcggggccatgtacgcggacgacacggccggctgggacacccgcatcaccgaggacgacctgcacaacgaggagaagatcacccagcagatggaccccgagcaccggcagctggccaacgccatcttcaagctcacgtaccagaacaaggtggtgaaggtccagcgcccgacccccaaggggaccgtgatggacatcatcagccggaaggaccagcgcggctccggccaggtggggacctacggcctgaacaccttcacgaacatggaggcccagctggtccggcagatggagggggagggcgtgctcagcaaggcggacctggagaacccccacctcctcgagaagaagatcacccagtggctggagaccgagggggtggagcgcctgaagcggatggccatctccggcgacgactgcgtcgtgaagcccatcgacgaccgcttcgccaacgccctcctggccctgaacgacatgggcaaggtgcggaaggacatcccgcagtggcagcccagcaaggggtggcacgactggcagcaggtccccttctgctcccaccacttccacgagctcatcatgaaggacggccgcaagctggtggtgccctgccgcccgcaggacgagctgatcgggcgggcgcgcatcagccagggcgccgggtggtccctcaaggagaccgcctgcctgggcaaggcctacgcccagatgtggagcctgatgtacttccaccggcgcgacctccggctggcgtccaacgccatctgcagcgccgtccccgtgcactggatccccacgtcccgcaccacctggagcatccacgcccaccaccagtggatgaccacggaggacatgctgaccgtgtggaaccgggtctggatcgaggacaacccctggatggaggacaagaccccggtgaccacgtgggaggacgtgccctacctcggcaagcgcgaggaccagtggtgcgggagcctgatcggcctgacctcccgggcgacctgggcccagaacatcctcaccgccatccagcaggtccgcagcctgatcggggacgaggagttcctggactacatgccctccatgaagcggttccgcaaggaggaggagagcgagggcgccatctggtga

SEQ ID NO: 10337 - RNA, 9873 nt, synthetic construct
  misc_feature 1..9873: note = derived and/or modified CDS sequence (opt1) from DENV-3__GU363549__SS-prME
  source 1..9873: mol_type = other RNA
accagcctgtgcctcatgatgatcctgcccgccgccctggcgttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgggacaagcggtccgtggccctcgcgccccacgtgggcatggggctggacacccggacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgagcaggggaaggcccacaacggccgcctgatcacggccaaccccgtcgtgaccaagaaggaggagcccgtgaacatcgaggccgagccgcccttcggcgagagcaacatcgtcatcgggatcggcgacaacgcgctgaagatcaactggtacaagaaggggtccagcatcggcaagatgttcgaggccaccgcccgcggggcccgccggatggccatcctgggcgacaccgcgtgggacttcggctccgtcgggggcgtgctcaacagcctggggaagatggtccaccagatcttcggctccgcctacacggccctgttcagcggggtgtcctgggtgatgaagatcggcatcggcgtcctcctgacctggatcgggctgaacagcaagaacacctccatgagcttctcctgcatcgccatcggcatcatcaccctctacctgggggccgtggtgcaggcggacatgggctgcgtcatcaactggaaggggaaggagctgaagtgcggcagcggcatcttcgtgacgaacgaggtgcacacctggaccgagcagtacaagttccaggccgactcccccaagcgcctcgccaccgccatcgccggggcgtgggagaacggcgtctgcgggatccgcagcacgacccggatggagaacctgctgtggaagcagatcgccaacgagctcaactacatcctgtgggagaacaacatcaagctgaccgtggtggtcggcgacaccatcggggtgctcgagcagggcaagcgcacgctgacgccccagccgatggagctgaagtactcctggaagacctggggcaaggccaagatcgtgaccgccgagacgcagaacagctccttcatcatcgacgggcccaacacccccgagtgccccagcgcgtcccgggcctggaacgtctgggaggtggaggactacggcttcggggtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacggctcctggaagctcgagaaggccagcctgatcgaggtcaagacgtgcacctggccgaagtcccacaccctgtggagcaacggggtgctcgagtccgacatgatcatccccaagagcctggccggccccatctcccagcacaactaccggccggggtaccacacccagacggccggcccctggcacctggggaagctcgagctggacttcaactactgcgagggcaccaccgtggtcatcaccgagaactgcggcacgcgcgggcccagcctgcggaccaccaccgtgtccggcaagctcatccacgagtggtgctgccgcagctgcacgctgcccccgctgcggtacatgggggaggacggctgctggtacgggatggagatccgccccatctccgagaaggaggagaacatggtcaagagcctcgtctccgccggcagcggcaaggtggacaacttcaccatgggggtgctgtgcctggcgatcctcttcgaggaggtcatgcggggcaagttcgggaagaagcacatgatcgccggcgtgttcctgaccttcatgctgctcctgtccgggcagatcacctggcgcgacatggcccacacgctgatcatgatcggcagcaacgcctccgaccggatgggcatgggggtgacctacctcgccctgatcgcgaccttcaagatccagcccttcctggccctcggcttcttcctgcgcaagctgaccagccgggagaacctcctgctgggggtcggcctcgccatggccacgaccatccagctgcccgaggacatcgagcagatggcgaacggcatcgccctggggctcatggccctgaagctgatcacccagttcgagacctaccagctctggacggccctgatcagcctgacctgctccaacaccatcttcaccctcacggtggcctggcgcaccgcgaccctgatcctggccggcgtgagcctcctgccggtctgccagtccagctccatgcggaagaccgactggctgcccatgacggtggccgccatgggggtgccgcccctcccgctgttcatcttcagcctgaaggacaccctcaagcgccgctcctggcccctgaacgagggcgtgatggccgtggggctggtcagcatcctcgcgtccagcctgctgcggaacgacgtgcccatggccggccccctcgtggccggcgggctgctgatcgcctgctacgtcatcaccggcacctccgccgacctcacggtggagaaggcggccgacgtgacctgggaggaggaggccgagcagaccggggtcagccacaacctgatgatcaccgtggacgacgacggcaccatgcgcatcaaggacgacgagacggagaacatcctgaccgtgctcctgaagaccgccctgctcatcgtctccgggatcttcccgtacagcatccccgccaccctgctggtgtggcacacgtggcagaagcagacccagcggtccggcgtgctctgggacgtccccagcccgcccgagacccagaaggcggagctggaggagggcgtgtaccgcatcaagcagcaggggatcctgggcaagacccaggtgggggtcggcgtgcagaaggagggggtgttccacacgatgtggcacgtcacccggggcgccgtgctcacccacaacggcaagcgcctggagcccaactgggcctccgtgaagaaggacctgatcagctacgggggcgggtggcggctctccgcccagtggcagaagggcgaggaggtccaggtgatcgcggtggagcccgggaagaaccccaagaacttccagaccatgcccggcacgttccagaccaccaccggcgagatcggggccatcgccctggacttcaagcccggcacgagcgggagccccatcatcaaccgcgagggcaaggtcgtgggcctgtacgggaacggcgtggtcaccaagaacgggggctacgtgtccgggatcgcccagaccaacgccgagccggacggccccacccccgagctggaggaggagatgttcaagaagcggaacctcacgatcatggacctgcaccccggcagcgggaagacccgcaagtacctgccggcgatcgtgcgggaggccatcaagcgccggctccgcaccctgatcctggcccccacccgggtcgtggccgccgagatggaggaggcgctcaagggcctgcccatccgctaccagacgaccgccaccaagtccgagcacaccgggcgggagatcgtggacctgatgcgccacgccacgttcaccatgcggctcctgagccccgtccgcgtgccgaactacaacctgatcatcatggacgaggcccacttcaccgaccccgcctccatcgcggcccggggctacatcagcacccgcgtggggatgggcgaggccgccgcgatcttcatgacggccacgccgcccggcaccgccgacgccttcccgcagtccaacgcccccatccaggacgaggagcgcgacatccccgagcggagctggaactccgggaacgagtggatcaccgacttcgcgggcaagacggtctggttcgtgcccagcatcaaggccgggaacgacatcgccaactgcctccgcaagaacggcaagaaggtgatccagctgtcccggaagaccttcgacaccgagtaccagaagaccaagctgaacgactgggacttcgtcgtgacgaccgacatcagcgagatgggggccaacttcaaggccgaccgcgtgatcgacccgcggcgctgcctcaagcccgtcatcctgaccgacggccccgagcgggtgatcctggcgggccccatgccggtgaccgtcgcctccgccgcccagcgccgggggcgcgtgggccggaacccccagaaggagaacgaccagtacatcttcaccgggcagcccctcaacaacgacgaggaccacgcccactggacggaggcgaagatgctgctggacaacatcaacacccccgagggcatcatcccggccctcttcgagcccgagcgcgagaagtccgccgccatcgacggggagtaccggctgaagggcgagtcccgcaagaccttcgtggagctgatgcggcgcggcgacctccccgtctggctggcgcacaaggtggccagcgaggggatcaagtacaccgaccggaagtggtgcttcgacggccagcgcaacaaccagatcctggaggagaacatggacgtcgagatctggacgaaggagggggagaagaagaagctccggccccgctggctggacgcccgcacctactccgacccgctggccctcaaggagttcaaggacttcgccgcgggccgcaagagcatcgccctggacctggtgaccgagatcggccgcgtgccctcccacctcgcccaccggacccgcaacgccctggacaacctggtcatgctccacacgagcgagcacgggggccgggcctaccgccacgcggtggaggagctgcccgagaccatggagaccctgctcctgctggggctcatgatcctgctgaccggcggggccatgctgttcctgatcagcggcaagggcatcgggaagacgtccatcggcctgatctgcgtgatcgccagctccgggatgctctggatggccgagatcccgctgcagtggatcgccagcgcgatcgtcctggagttcttcatgatggtgctcctgatccccgagcccgagaagcagcggacgccccaggacaaccagctggcctacgtggtcatcggcatcctcaccctggccgccatcatcgccgcgaacgagatggggctgctcgagaccacgaagcgcgacctgggcatgtccaaggagccgggcgtggtgagccccacctcctacctggacgtcgacctccaccccgccagcgcctggaccctgtacgccgtggcgaccacggtgatcacccccatgctgcggcacaccatcgagaactccaccgccaacgtcagcctcgccgccatcgccaaccaggcggtggtgctgatggggctggacaagggctggccgatctccaagatggacctcggggtccccctgctggccctcggctgctacagccaggtgaaccccctgacgctgaccgccgccgtgctcctgctggtcacccactacgccatcatcgggcccggcctccaggcgaaggccacccgcgaggcccagaagcggacggccgccggcatcatgaagaacccgaccgtggacgggatcatcaccatcgacctggaccccgtgatctacgactccaagttcgagaagcagctgggccaggtcatgctcctggtgctgtgcgcggtgcagctcctgctgatgcgcaccagctgggccctctgcgaggccctgacgctggccaccgggcccatcaccaccctctgggagggctcccccggcaagttctggaacacgaccatcgcggtcagcatggccaacatcttccgggggtcctacctggccggcgccgggctggccttcagcatcatgaagtccgtgggcaccgggaagcgcggcaccggcagccagggggagaccctcggcgagaagtggaagaagaagctgaaccagctgagccggaaggagttcgacctctacaagaagtccgggatcacggaggtggaccgcaccgaggcgaaggagggcctgaagcgcggggagaccacccaccacgccgtcagccgcggctccgccaagctgcagtggttcgtggagcggaacatggtgatcccggagggccgcgtcatcgacctcgggtgcggccgcgggggctggagctactactgcgccgggctgaagaaggtgacggaggtgcgcggctacaccaagggcgggcccggccacgaggagcccgtccccatgtccacccacgggtggaacatcgtgaagctgatgagcggcaaggacgtgttctacctcccgcccgagaagtgcgacaccctgctgtgcgacatcggggagtccagcccctcccccacggtcgaggagagccgcaccatccgggtgctgaagatggtggagccgtggctcaagaacaaccagttctgcatcaaggtcctgaacccctacatgcccgccgtgatcgagcacctggagcgcctccagcggaagcacggcggcatgctggtgcgcaaccccctgtcccggaacagcacccacgagatgtactggatctccaacgggaccggcaacatcgtcagctccgtgaacatggtgagccgcctcctgctgaaccggttcacgatgacccaccgccggccgaccatcgagaaggacgtcgacctcggggcgggcacccgccacgtgaacgccgagcccgagacgcccaacatggacgtgatcggcgagcggatccgccggatcaaggaggagcacaactccacctggcactacgacgacgagaacccgtacaagacctgggcctaccacgggagctacgaggtcaaggccaccggctccgccagcagcatgatcaacggggtggtcaagctgctgacgaagccctgggacgtggtgcccatggtcacccagatggcgatgaccgacaccacgcccttcggccagcagcgcgtgttcaaggagaaggtggacacccggaccccgcgccccatgcccgggacccggaaggtcatggagatcacggccgagtggctctggcgcaccctgggccggaacaagcgcccccgcctgtgcacccgggaggagttcaccaagaaggtgcgcacgaacgccgccatgggcgcggtgttcaccgaggagaaccagtgggactccgccaaggccgccgtcgaggacgaggagttctggaagctcgtggaccgggagcgcgagctgcacaagctggggaagtgcggcagctgcgtgtacaacatgatggggaagcgggagaagaagctcggcgagttcgggaaggccaagggctcccgcgcgatctggtacatgtggctgggcgcccggtacctggagttcgaggccctcgggttcctgaacgaggaccactggttcagccgcgagaactcctacagcggcgtcgagggggagggcctgcacaagctcgggtacatcctgcgggacatctccaagatcccgggcggcgccatgtacgccgacgacaccgcggggtgggacacccgcatcacggaggacgacctgcacaacgaggagaagatcacccagcagatgaaccccgagcaccggctcctggccaacgccatcttcaagctgacctaccagaacaaggtggtgaaggtccagcgccccacccccaccggcacggtgatggacatcatcagccggaaggaccagcgcgggtccggccaggtgggcacctacgggctcaacaccttcaccaacatggaggcccagctggtccggcagatggagggcgagggggtgctgagcaaggccgacctcgagaacccgcacctccccgagaagaagatcacgcagtggctggagaccaagggcgtggagcgcctcaagcggatggcgatctccggggacgactgcgtcgtgaagcccatcgacgaccgcttcgccaacgccctgctggccctcaacgacatgggcaaggtgcggaaggacatcccccagtggcagccgagcaagggctggcacgactggcagcaggtccccttctgctcccaccacttccacgagctgatcatgaaggacgggcgcaagctggtggtgccctgccggccccaggacgagctcatcggccgcgcccgcatcagccagggggcgggctggtccctgcgggagaccgcctgcctggggaaggcctacgcccagatgtggagcctcatgtacttccaccgccgggacctgcgcctggcgtccaacgccatctgcagcgccgtcccggtgcactgggtgcccacctcccggacgacctggagcatccacgcccaccaccagtggatgaccaccgaggacatgctcacggtctggaaccgcgtgtggatcgaggacaacccctggatggaggacaagacccccgtgaccacctgggagaacgtcccgtacctgggcaagcgggaggaccagtggtgcggcagcctgatcgggctcacgtcccgcgccacctgggcgcagaacatcagcaccgccatccagcaggtccggtccctgatcggcaacgaggagttcctggactacatgcccagcatgaagcgcttccggaaggaggaggagtccgagggggccatctggtga

SEQ ID NO: 10338 - RNA, 9873 nt, synthetic construct
  misc_feature 1..9873: note = derived and/or modified CDS sequence (opt1) from DENV-3__KJ622197__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccatcaccgagacccccacctggaaccgcaaggagctgctggtgacgttcaagaacgcccacgcgaagaagcaggaggtcgtggtgctcgggagccaggagggcgccatgcacaccgccctgaccggggccaccgagatccagaactccggcgggacgagcatcttcgccggccacctgaagtgccggctcaagatggacaagctggagctgaagggcatgtcctacgcgatgtgcctcaacaccttcgtcctgaagaaggaggtgagcgagacccagcacgggaccatcctgatcaaggtggagtacaagggcgaggacgccccctgcaagatcccgttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccaccgcccggggcgcccgccggatggcgatcctgggcgacacggcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacctccatgagcttctcctgcatcgtcatcggcatcatcacgctgtacctcgggaccgtggtgcaggccgacatgggctgcgtcatcaactggaagggcaaggagctgaagtgcgggagcggcatcttcgtgaccaacgaggtgcacacctggacggagcagtacaagttccaggcggactcccccaagcgcctggccaccgccatcgccggggcctgggagaacggcgtctgcgggatccgcagcaccacccggatggagaacctcctgtggaagcagatcgcgaacgagctgaactacatcctctgggagaacaacatcaagctgacggtggtggtcggcgacatcatcggcgtgctggagcaggggaagcgcaccctcacgccccagcccatggagctgaagtactcctggaagacctggggcaaggccaagatcgtgacggccgagatccagaacagctccttcatcatcgacgggccgaacacccccgagtgccccagcgcctcccgggcgtggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgccgacatggggtactggatcgagagccagaagaacggctcctggaagctggagaaggcgagcttcatcgaggtgaagacctgcacctggcccaagtcccacaccctctggagcaacggggtcctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtgatcacggagaactgcggcacccgcgggcccagcctccggaccaccacggtctccggcaagctgatccacgagtggtgctgccgcagctgcaccctgccgcccctgcggtacatgggggaggacggctgctggtacggcatggagatccgcccgatcaacgagaaggaggagaacatggtgaagtccctggtgagcgccgggtccggcaaggtcgacaacttcaccatgggggtgctgtgcctcgccatcctgttcgaggaggtgatgcggggcaagttcgggaagaagcacatgatcgcgggcgtcctgctcaccttcatgctgctgctcagcggccagatcacgtggcgcgacatggcccacaccctgatcatgatcgggtccaacgccagcgaccggatgggcatgggggtgacctacctggccctcatcgccaccttcaagatccagcccttcctggcgctgggcttcttcctccgcaagctgacgtcccgggagaacctgctcctgggcgtggggctggccatggccaccaccctccagctgcccgaggacatcgagcagatggccaacggcatcgcgctggggctcatggccctgaagctgatcacccagttcgagacgtaccagctctggaccgccctggtcagcctgacctgcagcaacaccatcttcacgctcaccgtggcctggcgcaccgccaccctgatcctggcgggcgtgtccctcctgcccgtctgccagagctccagcatgcggaagacggactggctgccggtggccgtcgccgccatgggggtgccgcccctccccctgttcatcttctccctgaaggacaccctcaagcgccgcagctggccgctgaacgagggcgtgatggccgtcggcctggtgtccatcctcgcgagctccctgctgcggaacgacgtgcccatggccgggcccctcgtcgccggcgggctgctgatcgcctgctacgtgatcaccggcaccagcgccgacctcacggtggagaaggcggccgacgtcacctgggaggaggaggccgagcagaccggggtgtcccacaacctgatgatcaccgtggacgacgacggcacgatgcgcatcaaggacgacgagaccgagaacatcctgaccgtcctcctgaagaccgccctgctcatcgtgagcggcatcttcccctactccatcccggccaccctgctggtgtggcacacgtggcagaagcagacccagcggagcggggtcctctgggacgtgcccagcccgcccgagacccagaaggcggagctggaggagggcgtgtaccgcatcaagcagcaggggatcttcggcaagacccaggtcggggtgggcgtgcagaaggagggcgtcttccacacgatgtggcacgtgacccgcggggccgtgctgacccacaacggcaagcgcctcgagccgaactgggccagcgtcaagaaggacctgatctcctacgggggcgggtggcggctgagcgcccagtggcagaagggcgaggaggtccaggtgatcgcggtcgagcccggccgcaaccccaagaacttccagaccatgcccgggatcttccagacgaccaccggcgagatcggggccatcgccctggacttcaagccgggcacctccggcagccccatcatcaaccgggaggggaaggtggtgggcctctacgggaacggcgtcgtgacgaagaacgggggctacgtgagcggcatcgcccaggccaacgcggagcccgacgggccgacccccgagctggaggaggagatgttcaagaagcgcaacctgaccatcatggacctccaccccggctccgggaagacccggaagtacctgcccgccatcgtccgcgaggccatcaagcggcgcctgcggacgctcatcctggccccgacccgcgtggtggccgcggagatggaggaggccctgaagggcctccccatccggtaccagaccaccgccaccaagtccgagcacaccgggcgcgagatcgtcgacctgatgtgccacgccaccttcaccatgcggctgctctcccccgtgcgcgtgcccaactacaacctgatcatcatggacgaggcccacttcacggacccggcgagcatcgccgcccggggctacatctccacccgcgtcggcatgggggaggccgcggccatcttcatgaccgccacgccgcccggcacggccgaggccttcccccagagcaacgcgccgatccaggacgaggagcgcgacatccccgagcggtcctggaacagcgggaacgagtggatcaccgacttcgtgggcaagaccgtgtggttcgtcccctccatcaaggccgggaacgacatcgccaactgcctgcgcaagaacggcaagaaggtgatccagctcagccggaagaccttcgacacggagtaccagaagaccaagctgaacgactgggacttcgtggtcaccaccgacatctccgagatgggcgccaacttcaaggccgaccgcgtgatcgacccccggcgctgcctgaagccggtgatcctcacggacgggcccgagcgggtcatcctggcgggccccatgcccgtgaccgccgccagcgccgcccagcgccgggggcgcgtgggccggaacccgcagaaggagaacgaccagtacatcttcaccgggcagcccctgaacaacgacgaggaccacgcgcactggaccgaggccaagatgctcctggacaacatcaacacgcccgagggcatcatccccgccctgttcgagccggagcgcgagaagtccgccgcgatcgacggcgagtaccggctcaagggggagagccgcaagaccttcgtcgagctgatgcggcgcggcgacctgcccgtgtggctcgcccacaaggtcgcctccgaggggatcaagtacaccgaccggaagtggtgcttcgacggcgagcgcaacaaccagatcctggaggagaacatggacgtggagatctggaccaaggagggcgagcggaagaagctgcgcccccgctggctcgacgcccggacctacagcaaccccctggccctgaaggagttcaaggacttcgcggccgggcgcaagtccatcgccctcgacctggtgacggagatcggccgggtcccgagccacctggcccaccgcacccggaacgccctcgacaacctggtgatgctgcacacctccgagcacgggggccgcgcgtaccggcacgccgtggaggagctccccgagaccatggagacgctgctgctcctggggctgatgatcctcctgaccggcggcgccatgctgttcctcatcagcgggaagggcatcgggaagaccagcatcggcctgatctgcgtcatcgtgtccagcgggatgctgtggatggccgacgtgcccctccagtggatcgcctccgcgatcgtcctggagttcttcatgatggtgctgctcatcccggagcccgagaagcagcgcacgccccaggacaaccagctggcctacgtggtcatcggcatcctgacgctcgccgccatcgtggccgcgaacgagatgggcctgctggagaccaccaagcgggacctcgggatgagcaaggagcccggcgtggtctccccgaccagctacctggacgtggacctgcaccccgcctccgcctggacgctctacgccgtggcgaccaccgtcatcacccccatgctgcgccacacgatcgagaacagcaccgccaacgtgtccctggccgccatcgccaaccaggcggtggtcctcatggggctggacaagggctggcccatcagcaagatggacctgggggtgccgctcctggccctgggctgctactcccaggtgaaccccctcaccctgaccgccgccgtcctgctcctggtgacgcactacgccatcatcggccccgggctgcaggcgaaggccacccgggaggcccagaagcgcaccgccgccggcatcatgaagaaccccaccgtggacgggatcatgacgatcgacctcgacccggtcatctacgacagcaagttcgagaagcagctgggccaggtgatgctgctcgtgctgtgcgcggtccagctgctcctgatgcggacctcctgggccctgtgcgaggccctcaccctggccaccggccccatcacgaccctgtgggaggggagccccggcaagttctggaacaccaccatcgcggtgtccatggccaacatcttccgcgggagctacctcgccggcgccgggctggccttctccatcatgaagtccgtgggcacgggcaagcgggggaccggctcccagggggagaccctgggcgagaagtggaagaagaagctcaaccagctgagccgccgggagttcgagctgtacaagaagtccgggatcaccgaggtcgaccgcacggaggcgaaggagggcctcaagcggggcgagaccacccaccacgccgtgtcccgcgggagcgccaagctgcagtggttcgtggagcggaacatggtcatccccgagggccgcgtgatcgacctggggtgcggccgcgggggctggtcctactactgcgccggcctcaagaaggtgaccgaggtccgggggtacaccaagggcgggccgggccacgaggagcccgtgcccatgagcacgtacgggtggaacaccgtgaagctgatgtccggcaaggacgtcttctacctgcccccggagaagtgcgacaccctgctctgcgacatcggcgagagctcccccagccccaccgtggaggagtcccgcacgatccgggtgctgaagatggtcgagccctggctgaagaacaaccagttctgcatcaaggtgctcaacccgtacatgcccaccgtgatcgagcacctggagcgcctgcagcggaagcacgggggcatgctcgtccgcaaccccctgagccggaactccacccacgagatgtactggatcagcaacgggaccggcaacatcgtgtccagcgtgaacatggtctcccgcctgctcctgaaccggttcacgatgacccaccgccggcccaccatcgagaaggacgtggacctgggcgccgggacccgccacgtcaacgcggagccggagacgcccaacatggacgtgatcggcgagcggatcaagcgcatcaaggaggagcacagctccacctggcactacgacgacgagaacccctacaagacctgggcctaccacgggagctacgaggtgaaggccaccggctccgccagcagcatgatcaacggggtcgtgaagctcctgacgaagccgtgggacgtggtccccatggtgacccagatggccatgaccgacaccacgcccttcggccagcagcgggtgttcaaggagaaggtcgacacccgcacgccccggccgatgcccggcacccgcaaggtgatggagatcaccgcggagtggctgtggcggaccctcgggcgcaacaagcgcccccggctgtgcacccgcgaggagttcaccaagaaggtgcggacgaacgccgccatgggcgccgtcttcaccgaggagaaccagtgggagtccgcgcgcgccgccgtggaggacgaggagttctggaagctggtggggcgggagcgcgagctccacaagctgggcaagtgcgggagctgcgtctacaacatgatgggcaagcgggagaagaagctgggcgagttcgggaaggccaagggctcccgcgccatctggtacatgtggctcggggcgcggtacctggagttcgaggccctgggcttcctcaacgaggaccactggttcagccgcgagaactcctacagcggggtggagggcgagggcctgcacaagctggggtacatcctccgggacatctccaagatccccggcggggccatgtacgccgacgacaccgccggctgggacacccgcatcacggaggacgacctgcacaacgaggagaagatcacccagcagatggacccggagcaccggcagctggcgaacgccatcttcaagctcacctaccagaacaaggtggtcaaggtgcagcgccccacccccaagggcacggtgatggacatcatcagccggaaggaccagcgcgggtccggccaggtcgggacctacggcctgaacaccttcaccaacatggaggcccagctgatccggcagatggagggggagggcgtgctcagcaaggccgacctggagaacccccacctcctcgagaagaagatcacccagtggctggagacgaagggcgtggagcgcctgaagcggatggccatctccggggacgactgcgtcgtgaagccgatcgacgaccgcttcgcgaacgccctcctggccctgaacgacatgggcaaggtgcggaaggacatcccccagtggcagcccagcaaggggtggcacgactggcagcaggtccccttctgctcccaccacttccacgagctcatcatgaaggacggccgcaagctggtggtgccgtgccgcccccaggacgagctgatcgggcgggcccgcatcagccagggcgccggctggtccctcaaggagaccgcgtgcctggggaaggcctacgcccagatgtggagcctgatgtacttccaccggcgcgacctccggctggcctccaacgcgatctgcagcgccgtccccgtgcactgggtgcccacctcccgcaccacgtggagcatccacgcccaccaccagtggatgaccaccgaggacatgctgaccgtctggaaccgggtgtggatcgaggacaacccgtggatggaggacaagacgcccgtgaccacctgggaggacgtcccctacctcggcaagcgcgaggaccagtggtgcgggagcctgatcggcctgacctcccgggccacgtgggcccagaacatcctcaccgcgatccagcaggtccgcagcctgatcggggacgaggagttcctggactacatgccctccatgaagcggttccgcaaggaggaggagagcgagggcgccatctggtga

SEQ ID NO: 10339 - RNA, 9873 nt, synthetic construct
  misc_feature 1..9873: note = derived and/or modified CDS sequence (opt1) from DENV-3__KJ622198__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccatcaccgagacccccacctggaaccgcaaggagctgctggtgacgttcaagaacgcccacgcgaagaagcaggaggtcgtggtgctcgggagccaggagggcgccatgcacaccgccctgaccggggccaccgagatccagaactccggcgggacgagcatcttcgccggccacctgaagtgccggctcaagatggacaagctggagctgaagggcatgtcctacgcgatgtgcctcaacaccttcgtcctgaagaaggaggtgagcgagacccagcacgggaccatcctgatcaaggtggagtacaagggcgaggacgccccctgcaagatcccgttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccaccgcccggggcgcccgccggatggcgatcctgggcgacacggcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacctccatgagcttctcctgcatcgtcatcggcatcatcacgctgtacctcgggaccgtggtgcaggccgacatgggctgcgtcatcaactggaagggcaaggagctgaagtgcgggagcggcatcttcgtgaccaacgaggtgcacacctggacggagcagtacaagttccaggcggactcccccaagcgcctggccaccgccatcgccggggcctgggagaacggcgtctgcgggatccgcagcaccacccggatggagaacctcctgtggaagcagatcgcgaacgagctgaactacatcctctgggagaacaacatcaagctgacggtggtggtcggcgacatcatcggcgtgctggagcaggggaagcgcaccctcacgccccagcccatggagctgaagtactcctggaagacctggggcaaggccaagatcgtgacggccgagatccagaacagctccttcatcatcgacgggccgaacacccccgagtgccccagcgcctcccgggcgtggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgccgacatggggtactggatcgagagccagaagaacggctcctggaagctggagaaggcgagcttcatcgaggtgaagacctgcacctggcccaagtcccacaccctctggagcaacggggtcctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtgatcacggagaactgcggcacccgcgggcccagcctccggaccaccacggtctccggcaagctgatccacgagtggtgctgccgcagctgcaccctgccgcccctccggtacatgggggaggacggctgctggtacggcatggagatccgcccgatcaacgagaaggaggagaacatggtgaagtccctggtgagcgccgggtccggcaaggtcgacaacttcaccatgggggtgctgtgcctcgccatcctgttcgaggaggtgatgcggggcaagttcgggaagaagcacatgatcgcgggcgtcctgctcaccttcatgctgctgctcagcggccagatcacgtggcgcgacatggcccacaccctgatcatgatcgggtccaacgccagcgaccggatgggcatgggggtgacctacctggccctcatcgccaccttcaagatccagcccttcctggcgctgggcttcttcctccgcaagctgacgtcccgggagaacctgctcctgggcgtggggctggccatggccaccaccctccagctgcccgaggacatcgagcagatggccaacggcatcgcgctggggctcatggccctgaagctgatcacccagttcgagacgtaccagctctggaccgccctggtcagcctgacctgcagcaacaccatcttcacgctcaccgtggcctggcgcaccgccaccctgatcctggcgggcgtgtccctcctgcccgtctgccagagctccagcatgcggaagacggactggctgccggtggccgtcgccgccatgggggtgccgcccctccccctgttcatcttctccctgaaggacaccctcaagcgccgcagctggccgctgaacgagggcgtgatggccgtcggcctggtgtccatcctcgcgagctccctgctgcggaacgacgtgcccatggccgggcccctcgtcgccggcgggctgctgatcgcctgctacgtgatcaccggcaccagcgccgacctcacggtggagaaggcggccgacgtcacctgggaggaggaggccgagcagaccggggtgtcccacaacctgatgatcaccgtggacgacgacggcacgatgcgcatcaaggacgacgagaccgagaacatcctgaccgtcctcctgaagaccgccctgctcatcgtgagcggcatcttcccctactccatcccggccaccctgctggtgtggcacacgtggcagaagcagacccagcggagcggggtcctctgggacgtgcccagcccgcccgagacccagaaggcggagctggaggagggcgtgtaccgcatcaagcagcaggggatcttcggcaagacccaggtcggggtgggcgtgcagaaggagggcgtcttccacacgatgtggcacgtgacccgcggggccgtgctgacccacaacggcaagcgcctcgagccgaactgggccagcgtcaagaaggacctgatctcctacgggggcgggtggcggctgagcgcccagtggcagaagggcgaggaggtccaggtgatcgcggtcgagcccggccgcaaccccaagaacttccagaccatgcccgggatcttccagacgaccaccggcgagatcggggccatcgccctggacttcaagccgggcacctccggcagccccatcatcaaccgggaggggaaggtggtgggcctctacgggaacggcgtcgtgacgaagaacgggggctacgtgagcggcatcgcccaggccaacgcggagcccgacgggccgacccccgagctggaggaggagatgttcaagaagcgcaacctgaccatcatggacctccaccccggctccgggaagacccggaagtacctgcccgccatcgtccgcgaggccatcaagcggcgcctgcggacgctcatcctggccccgacccgcgtggtggccgcggagatggaggaggccctgaagggcctccccatccggtaccagaccaccgccaccaagtccgagcacaccgggcgcgagatcgtcgacctgatgtgccacgccaccttcaccatgcggctgctctcccccgtgcgcgtgcccaactacaacctgatcatcatggacgaggcccacttcacggacccggcgagcatcgccgcccggggctacatctccacccgcgtcggcatgggggaggccgcggccatcttcatgaccgccacgccgcccggcacggccgaggccttcccccagagcaacgcgccgatccaggacgaggagcgcgacatccccgagcggtcctggaacagcgggaacgagtggatcaccgacttcgtgggcaagaccgtgtggttcgtcccctccatcaaggccgggaacgacatcgccaactgcctgcgcaagaacggcaagaaggtgatccagctcagccggaagaccttcgacacggagtaccagaagaccaagctgaacgactgggacttcgtggtcaccaccgacatctccgagatgggcgccaacttcaaggccgaccgcgtgatcgacccccggcgctgcctgaagccggtgatcctcacggacgggcccgagcgggtcatcctggcgggccccatgcccgtgaccgccgccagcgccgcccagcgccgggggcgcgtgggccggaacccgcagaaggagaacgaccagtacatcttcaccgggcagcccctgaacaacgacgaggaccacgcgcactggaccgaggccaagatgctcctggacaacatcaacacgcccgagggcatcatccccgccctgttcgagccggagcgcgagaagtccgccgcgatcgacggcgagtaccggctcaagggggagagccgcaagaccttcgtcgagctgatgcggcgcggcgacctgcccgtgtggctcgcccacaaggtcgcctccgaggggatcaagtacaccgaccggaagtggtgcttcgacggcgagcgcaacaaccagatcctggaggagaacatggacgtggagatctggaccaaggagggcgagcggaagaagctgcgcccccgctggctcgacgcccggacctacagcaaccccctggccctgaaggagttcaaggacttcgcggccgggcgcaagtccatcgccctcgacctggtgacggagatcggccgggtcccgagccacctggcccaccgcacccggaacgccctcgacaacctggtgatgctgcacacctccgagcacgggggccgcgcgtaccggcacgccgtggaggagctccccgagaccatggagacgctgctgctcctggggctgatgatcctcctgaccggcggcgccatgctgttcctcatcagcgggaagggcatcgggaagaccagcatcggcctgatctgcgtcatcgtgtccagcgggatgctgtggatggccgacgtgcccctccagtggatcgcctccgcgatcgtcctggagttcttcatgatggtgctgctcatcccggagcccgagaagcagcgcacgccccaggacaaccagctggcctacgtggtcatcggcatcctgacgctcgccgccatcgtggccgcgaacgagatgggcctgctggagaccaccaagcgggacctcgggatgagcaaggagcccggcgtggtctccccgaccagctacctggacgtggacctgcaccccgcctccgcctggacgctctacgccgtggcgaccaccgtcatcacccccatgctgcgccacacgatcgagaacagcaccgccaacgtgtccctggccgccatcgccaaccaggcggtggtcctcatggggctggacaagggctggcccatcagcaagatggacctgggggtgccgctcctggccctgggctgctactcccaggtgaaccccctcaccctgaccgccgccgtcctgctcctggtgacgcactacgccatcatcggccccgggctgcaggcgaaggccacccgggaggcccagaagcgcaccgccgccggcatcatgaagaaccccaccgtggacgggatcatgacgatcgacctcgacccggtcatctacgacagcaagttcgagaagcagctgggccaggtgatgctgctcgtgctgtgcgcggtccagctgctcctgatgcggacctcctgggccctgtgcgaggccctcaccctggccaccggccccatcacgaccctgtgggaggggagccccggcaagttctggaacaccaccatcgcggtgtccatggccaacatcttccgcgggagctacctcgccggcgccgggctggccttctccatcatgaagtccgtgggcacgggcaagcgggggaccggctcccagggggagaccctgggcgagaagtggaagaagaagctcaaccagctgagccgccgggagttcgagctgtacaagaagtccgggatcaccgaggtcgaccgcacggaggcgaaggagggcctcaagcggggcgagaccacccaccacgccgtgtcccgcgggagcgccaagctgcagtggttcgtggagcggaacatggtcatccccgagggccgcgtgatcgacctggggtgcggccgcgggggctggtcctactactgcgccggcctcaagaaggtgaccgaggtccgggggtacaccaagggcgggccgggccacgaggagcccgtgcccatgagcacgtacgggtggaacaccgtgaagctgatgtccggcaaggacgtcttctacctgcccccggagaagtgcgacaccctgctctgcgacatcggcgagagcctgccctcccccaccgtggaggagagccgcacgatccgggtgctgaagatggtcgagccctggctcaagaacaaccagttctgcatcaaggtgctgaacccgtacatgcccaccgtgatcgagcacctggagcgcctccagcggaagcacgggggcatgctggtccgcaaccccctgtcccggaacagcacccacgagatgtactggatctccaacgggaccggcaacatcgtgagctccgtgaacatggtcagccgcctcctgctgaaccggttcacgatgacccaccgccggcccaccatcgagaaggacgtggacctcggcgccgggacccgccacgtcaacgcggagccggagacgcccaacatggacgtgatcggcgagcggatcaagcgcatcaaggaggagcactccagcacctggcactacgacgacgagaacccctacaagacctgggcctaccacgggtcctacgaggtgaaggccaccggcagcgcctccagcatgatcaacggggtcgtgaagctgctgacgaagccgtgggacgtggtccccatggtgacccagatggccatgaccgacaccacgcccttcggccagcagcgggtgttcaaggagaaggtcgacacccgcacgccccggccgatgcccggcacccgcaaggtgatggagatcaccgcggagtggctctggcggaccctggggcgcaacaagcgcccccggctgtgcacccgcgaggagttcaccaagaaggtgcggacgaacgccgccatgggcgccgtcttcaccgaggagaaccagtgggagagcgcgcgcgccgccgtggaggacgaggagttctggaagctcgtggggcgggagcgcgagctgcacaagctgggcaagtgcgggtcctgcgtctacaacatgatgggcaagcgggagaagaagctcggcgagttcgggaaggccaagggcagccgcgccatctggtacatgtggctgggggcgcggtacctggagttcgaggccctcggcttcctgaacgaggaccactggttctcccgcgagaacagctactccggggtggagggcgagggcctgcacaagctcgggtacatcctgcgggacatcagcaagatccccggcggggccatgtacgccgacgacaccgccggctgggacacccgcatcacggaggacgacctgcacaacgaggagaagatcacccagcagatggacccggagcaccggcagctcgcgaacgccatcttcaagctgacctaccagaacaaggtggtcaaggtgcagcgccccacccccaagggcacggtgatggacatcatctcccggaaggaccagcgcgggagcggccaggtcgggacctacggcctgaacaccttcaccaacatggaggcccagctcatccggcagatggagggggagggcgtgctgtccaaggccgacctggagaacccccacctcctggagaagaagatcacccagtggctggagacgaagggcgtggagcgcctcaagcggatggccatcagcggggacgactgcgtcgtgaagccgatcgacgaccgcttcgcgaacgccctgctggccctcaacgacatgggcaaggtgcggaaggacatcccccagtggcagccctccaaggggtggcacgactggcagcaggtccccttctgcagccaccacttccacgagctgatcatgaaggacggccgcaagctggtggtgccgtgccgcccccaggacgagctcatcgggcgggcccgcatctcccagggcgccggctggagcctgaaggagaccgcgtgcctggggaaggcctacgcccagatgtggtccctcatgtacttccaccggcgcgacctgcggctggccagcaacgcgatctgctccgccgtccccgtgcactgggtgcccaccagccgcaccacgtggtccatccacgcccaccaccagtggatgaccaccgaggacatgctcaccgtctggaaccgggtgtggatcgaggacaacccgtggatggaggacaagacgcccgtgaccacctgggaggacgtcccctacctgggcaagcgcgaggaccagtggtgcgggagcctgatcggcctcaccagccgggccacgtgggcccagaacatcctgaccgcgatccagcaggtccgctccctgatcggggacgaggagttcctcgactacatgcccagcatgaagcggttccgcaaggaggaggagtccgagggcgccatctggtga

SEQ ID NO: 10340 - RNA, 9873 nt, synthetic construct
  misc_feature 1..9873: note = derived and/or modified CDS sequence (opt1) from DENV-3__KJ622191__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgaggtgatcctcctgaccatgaagaacaaggcctggatggtgcaccggcagtggttcttcgacctgccgctcccctggacgtccggcgccatcaccgagacccccacctggaaccgcaaggagctgctggtcacgttcaagaacgcccacgcgaagaagcaggaggtggtggtcctcgggagccaggagggcgccatgcacaccgccctgaccggggccaccgagatccagaactccggcgggacgagcatcttcgccggccacctgaagtgccggctcaagatggacaagctggagctgaagggcatgtcctacgcgatgtgcctcaacaccttcgtgctgaagaaggaggtgagcgagacccagcacgggaccatcctgatcaaggtcgagtacaagggcgaggacgccccctgcaagatcccgttcagcacggaggacgggcagggcaaggcccacaacggccgcctgatcaccgccaaccccgtggtgaccaagaaggaggagcccgtcaacatcgaggcggagcccccgttcggggagtccaacatcgtgatcggcatcggggacaaggccctcaagatcaactggtacaagaagggcagctccatcgggaagatgttcgaggccaccgcccggggcgcccgccggatggcgatcctgggcgacacggcctgggacttcgggagcgtgggcggggtcctgaactccctcggcaagatggtgcaccagatcttcgggagcgcctacaccgccctgttcggcggcgtgtcctggatcatgaagatcgggatcggcgtcctgctcacctggatcgggctgaacagcaagaacacctccatgagcttctcctgcatcgtgatcggcatcatcacgctgtacctcgggaccgtggtccaggccgacatgggctgcgtgatcaactggaagggcaaggagctgaagtgcgggagcggcatcttcgtgaccaacgaggtccacacctggacggagcagtacaagttccaggcggactcccccaagcgcctggccaccgccatcgccggggcctgggagaacggcgtgtgcgggatccgcagcaccacccggatggagaacctcctgtggaagcagatcgcgaacgagctgaactacatcctctgggagaacaacatcaagctgacggtggtcgtgggcgacatcatcggcgtgctggagcaggggaagcgcaccctcacgccccagcccatggagctgaagtactcctggaagacctggggcaaggccaagatcgtcacggccgagatccagaacagctccttcatcatcgacgggccgaacacccccgagtgccccagcgcctcccgggcgtggaacgtgtgggaggtggaggactacggcttcggcgtcttcaccaccaacatctggctgaagctccgcgaggtgtacacgcagacctgcgaccaccggctgatgagcgccgccatcaaggacgagcgcgccgtgcacgccgacatggggtactggatcgagagccagaagaacggctcctggaagctggagaaggcgagcttcatcgaggtcaagacctgcacctggcccaagtcccacaccctctggagcaacggggtgctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtcatcacggagaactgcggcacccgcgggcccagcctccggaccaccacggtgtccggcaagctgatccacgagtggtgctgccgcagctgcaccctgccgcccctgcggtacatgggggaggacggctgctggtacggcatggagatccgcccgatcaacgagaaggaggagaacatggtgaagtccctggtcagcgccgggtccggcaaggtggacaacttcaccatgggggtgctgtgcctcgccatcctgttcgaggaggtcatgcggggcaagttcgggaagaagcacatgatcgcgggcgtgctgctcaccttcatgctgctgctcagcggccagatcacgtggcgcgacatggcccacaccctgatcatgatcgggtccaacgccagcgaccggatgggcatgggggtgacctacctggccctcatcgccaccttcaagatccagcccttcctggcgctgggcttcttcctccgcaagctgacgtcccgggagaacctgctcctgggcgtcgggctggccatggccaccaccctccagctgcccgaggacatcgagcagatggccaacggcatcgcgctggggctcatggccctgaagctgatcacccagttcgagacgtaccagctctggaccgccctggtgagcctgacctgcagcaacaccatcttcacgctcaccgtggcctggcgcaccgccaccctgatcctggcgggcgtctccctcctgcccgtgtgccagagctccagcatgcggaagacggactggctgccggtcgccgtggccgccatgggggtgccgcccctccccctgttcatcttctccctgaaggacaccctcaagcgccgcagctggccgctgaacgagggcgtcatggccgtgggcctggtgtccatcctcgcgagctccctgctgcggaacgacgtccccatggccgggcccctcgtggccggcgggctgctgatcgcctgctacgtgatcaccggcaccagcgccgacctcacggtcgagaaggcggccgacgtgacctgggaggaggaggccgagcagaccggggtgtcccacaacctgatgatcaccgtcgacgacgacggcacgatgcgcatcaaggacgacgagaccgagaacatcctgaccgtgctcctgaagaccgccctgctcatcgtgagcggcatcttcccctactccatcccggccaccctgctggtctggcacacgtggcagaagcagacccagcggagcggggtgctctgggacgtgcccagcccgcccgagacccagaaggcggagctggaggagggcgtctaccgcatcaagcagcaggggatcttcggcaagacccaggtgggggtgggcgtccagaaggagggcgtgttccacacgatgtggcacgtgacccgcggggccgtcctgacccacaacggcaagcgcctcgagccgaactgggccagcgtgaagaaggacctgatctcctacgggggcgggtggcggctgagcgcccagtggcagaagggcgaggaggtgcaggtcatcgcggtggagcccggccgcaaccccaagaacttccagaccatgcccgggatcttccagacgaccatgggcgagatcggggccatcgccctggacttcaagccgggcacctccggcagccccatcatcaaccgggaggggaaggtggtcggcctctacgggaacggcgtggtgaccaagaacgggggctacgtcagcggcatcgcccaggccaacgcggagcccgacgggccgacgcccgagctggaggaggagatgttcaagaagcgcaacctgaccatcatggacctccaccccggctccgggaagacccggaagtacctgcccgccatcgtgcgcgaggccatcaagcggcgcctgcggaccctcatcctggccccgacgcgcgtggtcgccgcggagatggaggaggccctgaagggcctccccatccggtaccagaccaccgccaccaagagcgagcacacggggcgcgagatcgtggacctgatgtgccacgccaccttcaccatgcggctgctctcccccgtgcgcgtccccaactacaacctgatcatcatggacgaggcccacttcaccgacccggcgagcatcgccgcccggggctacatctccacgcgcgtgggcatgggggaggccgcggccatcttcatgaccgccacgccgcccggcaccgccgaggccttcccccagagcaacgcgccgatccaggacgaggagcgcgacatccccgagcggtcctggaacagcgggaacgagtggatcacggacttcgtgggcaagaccgtctggttcgtgccctccatcaaggccgggaacgacatcgccaactgcctgcgcaagaacggcaagaaggtgatccagctcagccggaagaccttcgacaccgagtaccagaagacgaagctgaacgactgggacttcgtcgtgaccaccgacatctccgagatgggcgccaacttcaaggccgaccgcgtgatcgacccccggcgctgcctgaagccggtcatcctcaccgacgggcccgagcgggtgatcctggcgggccccatgcccgtgacggccgccagcgccgcccagcgccgggggcgcgtcggccggaacccgcagaaggagaacgaccagtacatcttcaccgggcagcccctgaacaacgacgaggaccacgcgcactggaccgaggccaagatgctcctggacaacatcaacacccccgagggcatcatccccgccctgttcgagccggagcgcgagaagtccgccgcgatcgacggcgagtaccggctcaagggggagagccgcaagacgttcgtggagctgatgcggcgcggcgacctgcccgtctggctcgcccacaaggtggcctccgaggggatcaagtacaccgaccggaagtggtgcttcgacggcgagcgcaacaaccagatcctggaggagaacatggacgtggagatctggaccaaggagggcgagcggaagaagctgcgcccccgctggctcgacgcccggacctacagcgaccccctggccctgaaggagttcaaggacttcgcggccgggcgcaagtccatcgccctcgacctggtcaccgagatcggccgggtgccgagccacctggcccaccgcacgcggaacgccctcgacaacctggtgatgctgcacacctccgagcacgggggccgcgcgtaccggcacgccgtcgaggagctccccgagaccatggagaccctgctgctcctggggctgatgatcctcctgacgggcggcgccatgctgttcctcatcagcgggaagggcatcgggaagaccagcatcggcctgatctgcgtgatcgtgtccagcgggatgctgtggatggccgacgtccccctccagtggatcgcctccgcgatcgtgctggagttcttcatgatggtgctgctcatcccggagcccgagaagcagcgcacgccccaggacaaccagctggcctacgtcgtgatcggcatcctgaccctcgccgccatcgtggccgcgaacgagatgggcctgctggagacgaccaagcgggacctcgggatgagcaaggagcccggcgtcgtgtccccgaccagctacctggacgtggacctgcaccccgcctccgcctggaccctctacgccgtcgcgacgaccgtgatcacccccatgctgcgccacaccatcgagaacagcacggccaacgtgtccctggccgccatcgccaaccaggcggtcgtgctcatggggctggacaagggctggcccatcagcaagatggacctgggggtgccgctcctggccctgggctgctactcccaggtcaaccccctcaccctgaccgccgccgtgctgctcctggtgacccactacgccatcatcggccccgggctgcaggcgaaggccacgcgggaggcccagaagcgcaccgccgccggcatcatgaagaaccccaccgtcgacgggatcatgaccatcgacctcgacccggtgatctacgacagcaagttcgagaagcagctgggccaggtgatgctgctcgtcctgtgcgcggtgcagctgctcctgatgcggacgtcctgggccctgtgcgaggccctcaccctggccaccggccccatcaccacgctgtgggaggggagccccggcaagttctggaacaccaccatcgcggtgtccatggccaacatcttccgcgggagctacctcgccggcgccgggctggccttctccatcatgaagtccgtcggcaccggcaagcgggggacgggctcccagggggagaccctgggcgagaagtggaagaagaagctcaaccagctgagccgccgggagttcgagctgtacaagaagtccgggatcaccgaggtggaccgcaccgaggcgaaggagggcctcaagcggggcgagacgacccaccacgccgtgtcccgcgggagcgccaagctgcagtggttcgtcgagcggaacatggtgatccccgagggccgcgtgatcgacctggggtgcggccgcgggggctggtcctactactgcgccggcctcaagaaggtcaccgaggtgcgggggtacaccaagggcgggccgggccacgaggagcccgtgcccatgagcacctacgggtggaacacggtcaagctgatgtccggcaaggacgtgttctacctgcccccggagaagtgcgacaccctgctctgcgacatcggcgagagctcccccagccccaccgtggaggagtcccgcaccatccgggtcctgaagatggtggagccctggctgaagaacaaccagttctgcatcaaggtgctcaacccgtacatgcccacggtcatcgagcacctggagcgcctgcagcggaagcacgggggcatgctcgtgcgcaaccccctgagccggaactccacccacgagatgtactggatcagcaacgggaccggcaacatcgtgtccagcgtcaacatggtgtcccgcctgctcctgaaccggttcaccatgacgcaccgccggcccaccatcgagaaggacgtcgacctgggcgccgggacccgccacgtgaacgcggagccggagacccccaacatggacgtgatcggcgagcggatcaagcgcatcaaggaggagcacagctccacgtggcactacgacgacgagaacccctacaagacctgggcctaccacgggagctacgaggtcaaggccaccggctccgccagcagcatgatcaacggggtggtgaagctcctgaccaagccgtgggacgtcgtgcccatggtgacgcagatggccatgaccgacaccacccccttcggccagcagcgggtcttcaaggagaaggtggacacgcgcacgccccggccgatgcccggcacccgcaaggtgatggagatcaccgcggagtggctgtggcggaccctcgggcgcaacaagcgcccccggctgtgcacccgcgaggagttcaccaagaaggtccggaccaacgccgccatgggcgccgtgttcacggaggagaaccagtgggagtccgcgcgcgccgccgtggaggacgaggagttctggaagctggtcgggcgggagcgcgagctccacaagctgggcaagtgcgggagctgcgtgtacaacatgatgggcaagcgggagaagaagctgggcgagttcgggaaggccaagggctcccgcgccatctggtacatgtggctcggggcgcggtacctggagttcgaggccctgggcttcctcaacgaggaccactggttcagccgcgagaactcctacagcggggtggagggcgagggcctgcacaagctggggtacatcctccgggacatctccaagatccccggcggggccatgtacgccgacgacaccgccggctgggacacccgcatcaccgaggacgacctgcacaacgaggagaagatcacgcagcagatggacccggagcaccggcagctggcgaacgccatcttcaagctcacctaccagaacaaggtcgtgaaggtgcagcgccccacccccaagggcaccgtcatggacatcatcagccggaaggaccagcgcgggtccggccaggtggggacgtacggcctgaacaccttcaccaacatggaggcccagctgatccggcagatggagggggagggcgtgctcagcaaggccgacctggagaacccccacctcctcgagaagaagatcacccagtggctggagaccaagggcgtcgagcgcctgaagcggatggccatctccggggacgactgcgtggtgaagccgatcgacgaccgcttcgcgaacgccctcctggccctgaacgacatgggcaaggtccggaaggacatcccccagtggcagcccagcaaggggtggcacgactggcagcaggtccccttctgctcccaccacttccacgagctcatcatgaaggacggccgcaagctggtggtcccgtgccgcccccaggacgagctgatcgggcgggcccgcatcagccagggcgccggctggtccctcaaggagacggcgtgcctggggaaggcctacgcccagatgtggagcctgatgtacttccaccggcgcgacctccggctggcctccaacgcgatctgcagcgccgtgcccgtgcactgggtccccacctcccgcaccacctggagcatccacgcccaccaccagtggatgacgaccgaggacatgctgaccgtgtggaaccgggtgtggatcgaggacaacccgtggatggaggacaagacccccgtcacgacctgggaggacgtgccctacctcggcaagcgcgaggaccagtggtgcgggagcctgatcggcctgacctcccgggccacctgggcccagaacatcctcacggcgatccagcaggtccgcagcctgatcggggacgaggagttcctggactacatgccctccatgaagcggttccgcaaggaggaggagagcgagggcgccatctggtga

SEQ ID NO: 10341 - RNA, 9873 nt, synthetic construct
  misc_feature 1..9873: note = derived and/or modified CDS sequence (opt1) from DENV-3__KJ622192__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccatcaccgagacccccacctggaaccgcaaggagctgctggtgacgttcaagaacgcccacgcgaagaagcaggaggtcgtggtgctcgggagccaggagggcgccatgcacaccgccctgaccggggccaccgagatccagaactccggcgggacgagcatcttcgccggccacctgaagtgccggctcaagatggacaagctggagctgaagggcatgtcctacgcgatgtgcctcaacaccttcgtcctgaagaaggaggtgagcgagacccagcacgggaccatcctgatcaaggtggagtacaagggcgaggacgccccctgcaagatcccgttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccaccgcccggggcgcccgccggatggcgatcctgggcgacacggcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacctccatgagcttctcctgcatcgtcatcggcatcatcacgctgtacctcgggaccgtggtgcaggccgacatgggctgcgtcatcaactggaagggcaaggagctgaagtgcgggagcggcatcttcgtgaccaacgaggtgcacacctggacggagcagtacaagttccaggcggactcccccaagcgcctggccaccgccatcgccggggcctgggagaacggcgtctgcgggatccgcagcaccacccggatggagaacctcctgtggaagcagatcgcgaacgagctgaactacatcctctgggagaacaacatcaagctgacggtggtggtcggcgacatcatcggcgtgctggagcaggggaagcgcaccctcacgccccagcccatggagctgaagtactcctggaagacctggggcaaggccaagatcgtgacggccgagatccagaacagctccttcatcatcgacgggccgaacacccccgagtgccccagcgcctcccgggcgtggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgccgacatggggtactggatcgagagccagaagaacggctcctggaagctggagaaggcgagcttcatcgaggtgaagacctgcacctggcccaagtcccacaccctctggagcaacggggtcctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtgatcacggagaactgcggcacccgcgggcccagcctccggaccaccacggtctccggcaagctgatccacgagtggtgctgccgcagctgcaccctgccgcccctgcggtacatgggggaggacggctgctggtacggcatggagatccgcccgatcaacgagaaggaggagaacatggtgaagtccctggtgagcgccgggtccggcaaggtcgacaacttcaccatgggggtgctgtgcctcgccatcctgttcgaggaggtgatgcggggcaagttcgggaagaagcacatgatcgcgggcgtcctgctcaccttcatgctgctgctcagcggccagatcacgtggcgcgacatggcccacaccctgatcatgatcgggtccaacgccagcgaccggatgggcatgggggtgacctacctggccctcatcgccaccttcaagatccagcccttcctggcgctgggcttcttcctccgcaagctgacgtcccgggagaacctgctcctgggcgtggggctggccatggccaccaccctccagctgcccgaggacatcgagcagatggccaacggcatcgcgctggggctcatggccctgaagctgatcacccagttcgagacgtaccagctctggaccgccctggtcagcctgacctgcagcaacaccatcttcacgctcaccgtggcctggcgcaccgccaccctgatcctggcgggcgtgtccctcctgcccgtctgccagagctccagcatgcggaagacggactggctgccggtggccgtcgccgccatgggggtgccgcccctccccctgttcatcttctccctgaaggacaccctcaagcgccgcagctggccgctgaacgagggcgtgatggccgtcggcctggtgtccatcctcgcgagctccctgctgcggaacgacgtgcccatggccgggcccctcgtcgccggcgggctgctgatcgcctgctacgtgatcaccggcaccagcgccgacctcacggtggagaaggcggccgacgtcacctgggaggaggaggccgagcagaccggggtgtcccacaacctgatgatcaccgtggacgacgacggcacgatgcgcatcaaggacgacgagaccgagaacatcctgaccgtcctcctgaagaccgccctgctcatcgtgagcggcatcttcccctactccatcccggccaccctgctggtgtggcacacgtggcagaagcagacccagcggagcggggtcctctgggacgtgcccagcccgcccgagacccagaaggcggagctggaggagggcgtgtaccgcatcaagcagcaggggatcttcggcaagacccaggtcggggtgggcgtgcagaaggagggcgtcttccacacgatgtggcacgtgacccgcggggccgtgctgacccacaacggcaagcgcctcgagccgaactgggccagcgtcaagaaggacctgatctcctacgggggcgggtggcggctgagcgcccagtggcagaagggcgaggaggtccaggtgatcgcggtcgagcccggccgcaaccccaagaacttccagaccatgcccgggatcttccagacgaccaccggcgagatcggggccatcgccctggacttcaagccgggcacctccggcagccccatcatcaaccgggaggggaaggtggtgggcctctacgggaacggcgtcgtgacgaagaacgggggctacgtgagcggcatcgcccaggccaacgcggagcccgacgggccgacccccgagctggaggaggagatgttcaagaagcgcaacctgaccatcatggacctccaccccggctccgggaagacccggaagtacctgcccgccatcgtccgcgaggccatcaagcggcgcctgcggacgctcatcctggccccgacccgcgtggtggccgcggagatggaggaggccctgaagggcctccccatccggtaccagaccaccgccaccaagtccgagcacaccgggcgcgagatcgtcgacctgatgtgccacgccaccttcaccatgcggctgctctcccccgtgcgcgtgcccaactacaacctgatcatcatggacgaggcccacttcacggacccggcgagcatcgccgcccggggctacatctccacccgcgtcggcatgggggaggccgcggccatcttcatgaccgccacgccgcccggcacggccgaggccttcccccagagcaacgcgccgatccaggacgaggagcgcgacatccccgagcggtcctggaacagcgggaacgagtggatcaccgacttcgtgggcaagaccgtgtggttcgtcccctccatcaaggccgggaacgacatcgccaactgcctgcgcaagaacggcaagaaggtgatccagctcagccggaagaccttcgacacggagtaccagaagaccaagctgaacgactgggacttcgtggtcaccaccgacatctccgagatgggcgccaacttcaaggccgaccgcgtgatcgacccccggcgctgcctgaagccggtgatcctcacggacgggcccgagcgggtcatcctggcgggccccatgcccgtgaccgccgccagcgccgcccagcgccgggggcgcgtgggccggaacccgcagaaggagaacgaccagtacatcttcaccgggcagcccctgaacaacgacgaggaccacgcgcactggaccgaggccaagatgctcctggacaacatcaacacgcccgagggcatcatccccgccctgttcgagccggagcgcgagaagtccgccgcgatcgacggcgagtaccggctcaagggggagagccgcaagaccttcgtcgagctgatgcggcgcggcgacctgcccgtgtggctcgcccacaaggtcgcctccgaggggatcaagtacaccgaccggaagtggtgcttcgacggcgagcgcaacaaccagatcctggaggagaacatggacgtggagatctggaccaaggagggcgagcggaagaagctgcgcccccgctggctcgacgcccggacctacagcgaccccctggccctgaaggagttcaaggacttcgcggccgggcgcaagtccatcgccctcgacctggtgacggagatcggccgggtcccgagccacctggcccaccgcacccggaacgccctcgacaacctggtgatgctgcacacctccgagcacgggggccgcgcgtaccggcacgccgtggaggagctccccgagaccatggagacgctgctgctcctggggctgatgatcctcctgaccggcggcgccatgctgttcctcatcagcgggaagggcatcgggaagaccagcatcggcctgatctgcgtcatcgtgtccagcgggatgctgtggatggccgacgtgcccctccagtggatcgcctccgcgatcgtcctggagttcttcatgatggtgctgctcatcccggagcccgagaagcagcgcacgccccaggacaaccagctggcctacgtggtcatcggcatcctgacgctcgccgccatcgtggccgcgaacgagatgggcctgctggagaccaccaagcgggacctcgggatgagcaaggagcccggcgtggtctccccgaccagctacctggacgtggacctgcaccccgcctccgcctggacgctctacgccgtggcgaccaccgtcatcacccccatgctgcgccacacgatcgagaacagcaccgccaacgtgtccctggccgccatcgccaaccaggcggtggtcctcatggggctggacaagggctggcccatcagcaagatggacctgggggtgccgctcctggccctgggctgctactcccaggtgaaccccctcaccctgaccgccgccgtcctgctcctggtgacgcactacgccatcatcggccccgggctgcaggcgaaggccacccgggaggcccagaagcgcaccgccgccggcatcatgaagaaccccaccgtggacgggatcatgacgatcgacctcgacccggtcatctacgacagcaagttcgagaagcagctgggccaggtgatgctgctcgtgctgtgcgcggtccagctgctcctgatgcggacctcctgggccctgtgcgaggccctcaccctggccaccggccccatcacgaccctgtgggaggggagccccggcaagttctggaacaccaccatcgcggtgtccatggccaacatcttccgcgggagctacctcgccggcgccgggctggccttctccatcatgaagtccgtgggcacgggcaagcgggggaccggctcccagggggagaccctgggcgagaagtggaagaagaagctcaaccagctgagccgccgggagttcgagctgtacaagaagtccgggatcaccgaggtcgaccgcacggaggcgaaggagggcctcaagcggggcgagaccacccaccacgccgtgtcccgcgggagcgccaagctgcagtggttcgtggagcggaacatggtcatccccgagggccgcgtgatcgacctggggtgcggccgcgggggctggtcctactactgcgccggcctcaagaaggtgaccgaggtccgggggtacaccaagggcgggccgggccacgaggagcccgtgcccatgagcacgtacgggtggaacaccgtgaagctgatgtccggcaaggacgtcttctacctgcccccggagaagtgcgacaccctgctctgcgacatcggcgagagctcccccagccccaccgtggaggagtcccgcacgatccgggtgctgaagatggtcgagccctggctgaagaacaaccagttctgcatcaaggtgctcaacccgtacatgcccaccgtgatcgagcacctggagcgcctgcagcggaagcacgggggcatgctcgtccgcaaccccctgagccggaactccacccacgagatgtactggatcagcaacgggaccggcaacatcgtgtccagcgtgaacatggtctcccgcctgctcctgaaccggttcacgatgacccaccgccggcccaccatcgagaaggacgtggacctgggcgccgggacccgccacgtcaacgcggagccggagacgcccaacatggacgtgatcggcgagcggatcaagcgcatcaaggaggagcacagctccacctggcactacgacgacgagaacccctacaagacctgggcctaccacgggagctacgaggtgaaggccaccggctccgccagcagcatgatcaacggggtcgtgaagctcctgacgaagccgtgggacgtggtccccatggtgacccagatggccatgaccgacaccacgcccttcggccagcagcgggtgttcaaggagaaggtcgacacccgcacgccccggccgatgcccggcacccgcaaggtgatggagatcaccgcggagtggctgtggcggaccctcgggcgcaacaagcgcccccggctgtgcacccgcgaggagttcaccaagaaggtgcggacgaacgccgccatgggcgccgtcttcaccgaggagaaccagtgggagtccgcgcgcgccgccgtggaggacgaggagttctggaagctggtggggcgggagcgcgagctccacaagctgggcaagtgcgggagctgcgtctacaacatgatgggcaagcgggagaagaagctgggcgagttcgggaaggccaagggctcccgcgccatctggtacatgtggctcggggcgcggtacctggagttcgaggccctgggcttcctcaacgaggaccactggttcagccgcgagaactcctacagcggggtggagggcgagggcctgcacaagctggggtacatcctccgggacatctccaagatccccggcggggccatgtacgccgacgacaccgccggctgggacacccgcatcacggaggacgacctgcacaacgaggagaagatcacccagcagatggacccggagcaccggcagctggcgaacgccatcttcaagctcacctaccagaacaaggtggtcaaggtgcagcgccccacccccaagggcacggtgatggacatcatcagccggaaggaccagcgcgggtccggccaggtcgggacctacggcctgaacaccttcaccaacatggaggcccagctgatccggcagatggagggggagggcgtgctcagcaaggccgacctggagaacccccacctcctcgagaagaagatcacccagtggctggagacgaagggcgtggagcgcctgaagcggatggccatctccggggacgactgcgtcgtgaagccgatcgacgaccgcttcgcgaacgccctcctggccctgaacgacatgggcaaggtgcggaaggacatcccccagtggcagcccagcaaggggtggcacgactggcagcaggtccccttctgctcccaccacttccacgagctcatcatgaaggacggccgcaagctggtggtgccgtgccgcccccaggacgagctgatcgggcgggcccgcatcagccagggcgccggctggtccctcaaggagaccgcgtgcctggggaaggcctacgcccagatgtggagcctgatgtacttccaccggcgcgacctccggctggcctccaacgcgatctgcagcgccgtccccgtgcactgggtgcccacctcccgcaccacgtggagcatccacgcccaccaccagtggatgaccaccgaggacatgctgaccgtctggaaccgggtgtggatcgaggacaacccgtggatggaggacaagacgcccgtgaccacctgggaggacgtcccctacctcggcaagcgcgaggaccagtggtgcgggagcctgatcggcctgacctcccgggccacgtgggcccagaacatcctcaccgcgatccagcaggtccgcagcctgatcggggacgaggagttcctggactacatgccctccatgaagcggttccgcaaggaggaggagagcgagggcgccatctggtga

SEQ ID NO: 10342 - RNA, 9873 nt, synthetic construct
  misc_feature 1..9873: note = derived and/or modified CDS sequence (opt1) from DENV-3__KJ622193__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccatcaccgagacccccacctggaaccgcaaggagctgctggtgacgttcaagaacgcccacgcgaagaagcagggggtcgtggtgctcggcagccaggagggggccatgcacaccgccctgaccggcgccaccgagatccagaactccgggggcacgagcatcttcgccggccacctgaagtgccggctcaagatggacaagctggagctgaaggggatgtcctacgcgatgtgcctcaacaccttcgtcctgaagaaggaggtgagcgagacccagcacggcaccatcctgatcaaggtggagtacaagggggaggacgccccctgcaagatcccgttcagcacggaggacggccagggcaaggcccacaacgggcgcctgatcaccgccaaccccgtcgtgaccaagaaggaggagcccgtgaacatcgaggcggagcccccgttcggcgagtccaacatcgtcatcgggatcggcgacaaggccctcaagatcaactggtacaagaaggggagctccatcggcaagatgttcgaggccaccgcccggggcgcccgccggatggcgatcctgggggacacggcctgggacttcggcagcgtcggcggggtgctgaactccctcgggaagatggtccaccagatcttcgggagcgcctacaccgccctgttcggcggggtgtcctggatcatgaagatcggcatcggggtgctgctcacctggatcggcctgaacagcaagaacacctccatgagcttctcctgcatcgtcatcgggatcatcacgctgtacctcggcaccgtggtgcaggccgacatgggctgcgtcatcaactggaaggggaaggagctgaagtgcggcagcgggatcttcgtgaccaacgaggtgcacacctggacggagcagtacaagttccaggcggactcccccaagcgcctggccaccgccatcgccggcgcctgggagaacggggtctgcggcatccgcagcaccacccggatggagaacctcctgtggaagcagatcgcgaacgagctgaactacatcctctgggagaacaacatcaagctgacggtggtggtcggcgacatcatcggggtgctggagcagggcaagcgcaccctcacgccccagcccatggagctgaagtactcctggaagacctgggggaaggccaagatcgtgacggccgagatccagaacagctccttcatcatcgacggcccgaacacccccgagtgccccagcgcctcccgggcgtggaacgtctgggaggtggaggactacggcttcggggtgttcaccaccaacatctggctgaagctccgcgaggtctacacgcagacctgcgaccaccggctgatgagcgccgccatcaaggacgagcgcgccgtgcacgccgacatgggctactggatcgagagccagaagaacgggtcctggaagctggagaaggcgagcttcatcgaggtgaagacctgcacctggcccaagtcccacaccctctggagcaacggcgtcctggagtccgacatgatcatccccaagagcctggccgggcccatctcccagcacaaccaccggcccggctaccacacgcagaccgccggcccgtggcacctcgggaagctggagctggacttcaactactgcgagggcaccaccgtggtgatcacggagaactgcgggacccgcggccccagcctccggaccaccacggtctccgggaagctgatccacgagtggtgctgccgcagctgcaccctgccgcccctgcggtacatgggcgaggacggctgctggtacgggatggagatccgcccgatcaacgagaaggaggagaacatggtgaagtccctggtgagcgccggctccgggaaggtcgacaacttcaccatgggcgtgctgtgcctcgccatcctgttcgaggaggtgatgcgggggaagttcggcaagaagcacatgatcgcgggcgtcctgctcaccttcatgctgctgctcagcgggcagatcacgtggcgcgacatggcccacaccctgatcatgatcggctccaacgccagcgaccggatggggatgggcgtgacctacctggccctcatcgccaccttcaagatccagcccttcctggcgctgggcttcttcctccgcaagctgacgtcccgggagaacctgctcctgggggtgggcctggccatggccaccaccctccagctgcccgaggacatcgagcagatggccaacgggatcgcgctgggcctcatggccctgaagctgatcacccagttcgagacgtaccagctctggaccgccctggtcagcctgacctgcagcaacaccatcttcacgctcaccgtggcctggcgcaccgccaccctgatcctggcgggggtgtccctcctgcccgtctgccagagctccagcatgcggaagacggactggctgccggtggccgtcgccgccatgggcgtgccgcccctccccctgttcatcttctccctgaaggacaccctcaagcgccgcagctggccgctgaacgagggcgtgatggccgtcgggctggtgtccatcctcgcgagctccctgctgcggaacgacgtgcccatggccggccccctcgtcgccgggggcctgctgatcgcctgctacgtgatcaccgggaccagcgccgacctcacggtggagaaggcggccgacgtcacctgggaggaggaggccgagcagaccggcgtgtcccacaacctgatgatcaccgtggacgacgacggcacgatgcgcatcaaggacgacgagaccgagaacatcctgaccgtcctcctgaagaccgccctgctcatcgtgagcgggatcttcccctactccatcccggccaccctgctggtgtggcacacgtggcagaagcagacccagcggagcggcgtcctctgggacgtgcccagcccgcccgagacccagaaggcggagctggaggagggggtgtaccgcatcaagcagcagggcatcttcgggaagacccaggtcggcgtgggcgtgcagaaggagggggtcttccacacgatgtggcacgtgacccggggcgccgtgctgacccacaacgggaagcgcctcgagccgaactgggccagcgtcaagaaggacctgatctcctacggcgggggctggcggctgagcgcccagtggcagaagggcgaggaggtccaggtgatcgcggtcgagcccgggcgcaaccccaagaacttccagaccatgcccggcatcttccagacgaccaccggggagatcggcgccatcgccctggacttcaagccgggcacctccgggagccccatcatcaaccgggagggcaaggtggtggggctctacggcaacggggtcgtgacgaagaacggcggctacgtgagcgggatcgcccaggccaacgcggagcccgacggcccgacccccgagctggaggaggagatgttcaagaagcgcaacctgaccatcatggacctccaccccgggtccggcaagacccggaagtacctgcccgccatcgtccgcgaggccatcaagcggcgcctgcggacgctcatcctggccccgacccgcgtggtggccgcggagatggaggaggccctgaaggggctccccatccggtaccagaccaccgccaccaagtccgagcacaccggccgcgagatcgtcgacctgatgtgccacgccaccttcaccatgcggctgctctcccccgtgcgcgtgcccaactacaacctgatcatcatggacgaggcccacttcacggacccggcgagcatcgccgcccggggctacatctccacccgcgtcgggatgggcgaggccgcggccatcttcatgaccgccacgccgcccgggacggccgaggccttcccccagagcaacgcgccgatccaggacgaggagcgcgacatccccgagcggtcctggaacagcggcaacgagtggatcaccgacttcgtggggaagaccgtgtggttcgtcccctccatcaaggccggcaacgacatcgccaactgcctgcgcaagaacggcaagaaggtgatccagctcagccggaagaccttcgacacggagtaccagaagaccaagctgaacgactgggacttcgtggtcaccaccgacatctccgagatgggggccaacttcaaggccgaccgcgtgatcgacccccggcgctgcctgaagccggtgatcctcacggacggccccgagcgggtcatcctggcggggcccatgcccgtgaccgccgccagcgccgcccagcgccggggccgcgtggggcggaacccgcagaaggagaacgaccagtacatcttcaccggccagcccctgaacaacgacgaggaccacgcgcactggaccgaggccaagatgctcctggacaacatcaacacgcccgagggcatcatccccgccctgttcgagccggagcgcgagaagtccgccgcgatcgacggggagtaccggctcaagggcgagagccgcaagaccttcgtcgagctgatgcggcgcggggacctgcccgtgtggctcgcccacaaggtcgcctccgagggcatcaagtacaccgaccggaagtggtgcttcgacggcgagcgcaacaaccagatcctggaggagaacatggacgtggagatctggaccaaggagggggagcggaagaagctgcgcccccgctggctcgacgcccggacctacagcgaccccctggccctgaaggagttcaaggacttcgcggccggccgcaagtccatcgccctcgacctggtgacggagatcgggcgggtcccgagccacctggcccaccgcacccggaacgccctcgacaacctggtgatgctgcacacctccgagcacggcgggcgcgcgtaccggcacgccgtggaggagctccccgagaccatggagacgctgctgctcctgggcctgatgatcctcctgaccggcggggccatgctgttcctcatcagcggcaaggggatcggcaagaccagcatcgggctgatctgcgtcatcgtgtccagcggcatgctgtggatggccgacgtgcccctccagtggatcgcctccgcgatcgtcctggagttcttcatgatggtgctgctcatcccggagcccgagaagcagcgcacgccccaggacaaccagctggcctacgtggtcatcggcatcctgacgctcgccgccatcgtggccgcgaacgagatggggctgctggagaccaccaagcgggacctcggcatgagcaaggagcccggggtggtctccccgaccagctacctggacgtggacctgcaccccgcctccgcctggacgctctacgccgtggcgaccaccgtcatcacccccatgctgcgccacacgatcgagaacagcaccgccaacgtgtccctggccgccatcgccaaccaggcggtggtcctcatgggcctggacaaggggtggcccatcagcaagatggacctgggcgtgccgctcctggccctgggctgctactcccaggtgaaccccctcaccctgaccgccgccgtcctgctcctggtgacgcactacgccatcatcgggcccggcctgcaggcgaaggccacccgggaggcccagaagcgcaccgccgccgggatcatgaagaaccccaccgtggacggcatcatgacgatcgacctcgacccggtcatctacgacagcaagttcgagaagcagctgggccaggtgatgctgctcgtgctgtgcgcggtccagctgctcctgatgcggacctcctgggccctgtgcgaggccctcaccctggccaccgggcccatcacgaccctgtgggagggcagccccgggaagttctggaacaccaccatcgcggtgtccatggccaacatcttccgcggcagctacctcgccggggccggcctggccttctccatcatgaagtccgtgggcacggggaagcggggcaccgggtcccagggcgagaccctgggggagaagtggaagaagaagctcaaccagctgagccgccgggagttcgagctgtacaagaagtccggcatcaccgaggtcgaccgcacggaggcgaaggagggcctcaagcgcggggagaccacccaccacgccgtgtcccgcggcagcgccaagctgcagtggttcgtggagcggaacatggtcatccccgaggggcgcgtgatcgacctgggctgcgggcgcggcggctggtcctactactgcgccgggctcaagaaggtgaccgaggtccggggctacaccaagggcggcccggggcacgaggagcccgtgcccatgagcacgtacggctggaacaccgtgaagctgatgtccggcaaggacgtcttctacctgcccccggagaagtgcgacaccctgctctgcgacatcggggagagctcccccagccccaccgtggaggagtcccgcacgatccgggtgctgaagatggtcgagccctggctgaagaacaaccagttctgcatcaaggtgctcaacccgtacatgcccaccgtgatcgagcacctggagcgcctgcagcggaagcacggcgggatgctcgtccgcaaccccctgagccggaactccacccacgagatgtactggatcagcaacggcaccggcaacatcgtgtccagcgtgaacatggtctcccgcctgctcctgaaccggttcacgatgacccaccgccggcccaccatcgagaaggacgtggacctgggggccggcacccgccacgtcaacgcggagccggagacgcccaacatggacgtgatcggggagcggatcaagcgcatcaaggaggagcacagctccacctggcactacgacgacgagaacccctacaagacctgggcctaccacggcagctacgaggtgaaggccaccgggtccgccagcagcatgatcaacggcgtcgtgaagctcctgacgaagccgtgggacgtggtccccatggtgacccagatggccatgaccgacaccacgcccttcggccagcagcgggtgttcaaggagaaggtcgacacccgcacgccccggccgatgcccgggacccgcaaggtgatggagatcaccgcggagtggctgtggcggaccctcggccgcaacaagcgcccccggctgtgcacccgcgaggagttcaccaagaaggtgcggacgaacgccgccatgggggccgtcttcaccgaggagaaccagtgggagtccgcgcgcgccgccgtggaggacgaggagttctggaagctggtgggccgggagcgcgagctccacaagctggggaagtgcggcagctgcgtctacaacatgatgggcaagcgggagaagaagctgggggagttcggcaaggccaaggggtcccgcgccatctggtacatgtggctcggcgcgcggtacctggagttcgaggccctggggttcctcaacgaggaccactggttcagccgcgagaactcctacagcggcgtggagggcgaggggctgcacaagctgggctacatcctccgggacatctccaagatccccgggggcgccatgtacgccgacgacaccgccggctgggacacccgcatcacggaggacgacctgcacaacgaggagaagatcacccagcagatggacccggagcaccggcagctggcgaacgccatcttcaagctcacctaccagaacaaggtggtcaaggtgcagcgccccacccccaaggggacggtgatggacatcatcagccggaaggaccagcgcggctccgggcaggtcggcacctacgggctgaacaccttcaccaacatggaggcccagctgatccggcagatggagggcgagggcgtgctcagcaaggccgacctggagaacccccacctcctcgagaagaagatcacccagtggctggagacgaagggggtggagcgcctgaagcggatggccatctccggcgacgactgcgtcgtgaagccgatcgacgaccgcttcgcgaacgccctcctggccctgaacgacatggggaaggtgcggaaggacatcccccagtggcagcccagcaagggctggcacgactggcagcaggtccccttctgctcccaccacttccacgagctcatcatgaaggacgggcgcaagctggtggtgccgtgccgcccccaggacgagctgatcggccgggcccgcatcagccagggcgccgggtggtccctcaaggagaccgcgtgcctgggcaaggcctacgcccagatgtggagcctgatgtacttccaccggcgcgacctccggctggcctccaacgcgatctgcagcgccgtccccgtgcactgggtgcccacctcccgcaccacgtggagcatccacgcccaccaccagtggatgaccaccgaggacatgctgaccgtctggaaccgggtgtggatcgaggacaacccgtggatggaggacaagacgcccgtgaccacctgggaggacgtcccctacctcgggaagcgcgaggaccagtggtgcggcagcctgatcgggctgacctcccgggccacgtgggcccagaacatcctcaccgcgatccagcaggtccgcagcctgatcggcgacgaggagttcctggactacatgccctccatgaagcggttccgcaaggaggaggagagcgagggcgccatctggtga

SEQ ID NO: 10343 - RNA, 9873 nt, synthetic construct
  misc_feature 1..9873: note = derived and/or modified CDS sequence (opt1) from DENV-3__KJ622194__SS-prME
  source 1..9873: mol_type = other RNA
accagcctgtgcctcatgatgatgctgcccgccaccctggccttccacctcacctcccgggacggcgagccccggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccatcaccgagacccccacctggaaccgcaaggagctgctggtgacgttcaagaacgcccacgcgaagaagcaggaggtcgtggtgctcgggagccaggagggcgccatgcacaccgccctgaccggggccaccgagatccagaactccggcgggacgagcatcttcgccggccacctgaagtgccggctcaagatggacaagctggagctgaagggcatgtcctacgcgatgtgcctcaacaccttcgtcctgaagaaggaggtgagcgagacccagcacgggaccatcctgatcaaggtggagtacaagggcgaggacgccccctgcaagatcccgttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccaccgcccggggcgcccgccggatggcgatcctgggcgacacggcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacctccatgagcttctcctgcatcgtcatcggcatcatcacgctgtacctcgggaccgtggtgcaggccgacatgggctgcgtcatcaactggaagggcaaggagctgaagtgcgggagcggcatcttcgtgaccaacgaggtgcacacctggacggagcagtacaagttccaggcggactcccccaagcgcctggccaccgccatcgccggggcctgggagaacggcgtctgcgggatccgcagcaccacccggatggagaacctcctgtggaagcagatcgcgaacgagctgaactacatcctctgggagaacaacatcaagctgacggtggtggtcggcgacatcatcggcgtgctggagcaggggaagcgcaccctcacgccccagcccatggagctgaagtactcctggaagacctggggcaaggccaagatcgtgacggccgagatccagaacagctccttcatcatcgacgggccgaacacccccgagtgccccagcgcctcccgggcgtggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgccgacatggggtactggatcgagagccagaagaacggctcctggaagctggagaaggcgagcttcatcgaggtgaagacctgcacctggcccaagtcccacaccctctggagcaacggggtcctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtgatcacggagaactgcggcacccgcgggcccagcctccggaccaccacggtctccggcaagctgatccacgagtggtgctgccgcagctgcaccctgccgcccctgcggtacatgggggaggacggctgctggtacggcatggagatccgcccgatcaacgagaaggaggagaacatggtgaagtccctggtgagcgccgggtccggcaaggtcgacaacttcaccatgggggtgctgtgcctcgccatcctgttcgaggaggtgatgcggggcaagttcgggaagaagcacatgatcgcgggcgtcctgctcaccttcatgctgctgctcagcggccagatcacgtggcgcgacatggcccacaccctgatcatgatcgggtccaacgccagcgaccggatgggcatgggggtgacctacctggccctcatcgccaccttcaagatccagcccttcctggcgctgggcttcttcctccgcaagctgacgtcccgggagaacctgctcctgggcgtggggctggccatggccaccaccctccagctgcccgaggacatcgagcagatggccaacggcatcgcgctggggctcatggccctgaagctgatcacccagttcgagacgtaccagctctggaccgccctggtcagcctgacctgcagcaacaccatcttcacgctcaccgtggcctggcgcaccgccaccctgatcctggcgggcgtgtccctcctgcccgtctgccagagctccagcatgcggaagacggactggctgccggtggccgtcgccgccatgggggtgccgcccctccccctgttcatcttctccctgaaggacaccctcaagcgccgcagctggccgctgaacgagggcgtgatggccgtcggcctggtgtccatcctcgcgagctccctgctgcggaacgacgtgcccatggccgggcccctcgtcgccggcgggctgctgatcgcctgctacgtgatcaccggcaccagcgccgacctcacggtggagaaggcggccgacgtcacctgggaggaggaggccgagcagaccggggtgtcccacaacctgatgatcaccgtggacgacgacggcacgatgcgcatcaaggacgacgagaccgagaacatcctgaccgtcctcctgaagaccgccctgctcatcgtgagcggcatcttcccctactccatcccggccaccctgctggtgtggcacacgtggcagaagcagacccagcggagcggggtcctctgggacgtgcccagcccgcccgagacccagaaggcggagctggaggagggcgtgtaccgcatcaagcagcaggggatcttcggcaagacccaggtcggggtgggcgtgcagaaggagggcgtcttccacacgatgtggcacgtgacccgcggggccgtgctgacccacagcggcaagcgcctcgagccgaactgggcctccgtcaagaaggacctgatcagctacgggggcgggtggcggctgtccgcccagtggcagaagggcgaggaggtccaggtgatcgcggtcgagcccggccgcaaccccaagaacttccagaccatgcccgggatcttccagacgaccaccggcgagatcggggccatcgccctggacttcaagccgggcaccagcggcagccccatcatcaaccgggaggggaaggtggtgggcctctacgggaacggcgtcgtgacgaagaacgggggctacgtgtccggcatcgcccaggccaacgcggagcccgacgggccgacccccgagctggaggaggagatgttcaagaagcgcaacctgaccatcatggacctccaccccggcagcgggaagacccggaagtacctgcccgccatcgtccgcgaggccatcaagcggcgcctgcggacgctcatcctggccccgacccgcgtggtggccgcggagatggaggaggccctgaagggcctccccatccggtaccagaccaccgccacgaagtccgagcacaccgggcgcgagatcgtcgacctgatgtgccacgccaccttcaccatgcggctgctcagccccgtgcgcgtgcccaactacaacctgatcatcatggacgaggcccacttcacggacccggcgtccatcgccgcccggggctacatcagcacccgcgtcggcatgggggaggccgcggccatcttcatgaccgccacgccgcccggcacggccgaggccttcccccagtccaacgcgccgatccaggacgaggagcgcgacatccccgagcggagctggaactccgggaacgagtggatcaccgacttcgtgggcaagaccgtgtggttcgtccccagcatcaaggccgggaacgacatcgccaactgcctgcgcaagaacggcaagaaggtgatccagctctcccggaagaccttcgacacggagtaccagaagaccaagctgaacgactgggacttcgtggtcaccaccgacatcagcgagatgggcgccaacttcaaggccgaccgcgtgatcgacccccggcgctgcctgaagccggtgatcctcacggacgggcccgagcgggtcatcctggcgggccccatgcccgtgaccgccgcctccgccgcccagcgccgggggcgcgtgggccggaacccgcagaaggagaacgaccagtacatcttcaccgggcagcccctgaacaacgacgaggaccacgcgcactggaccgaggccaagatgctcctggacaacatcaacacgcccgagggcatcatccccgccctgttcgagccggagcgcgagaagtccgccgcgatcgacggcgagtaccggctcaagggggagtcccgcaagaccttcgtcgagctgatgcggcgcggcgacctgcccgtgtggctcgcccacaaggtcgccagcgaggggatcaagtacaccgaccggaagtggtgcttcgacggcgagcgcaacaaccagatcctggaggagaacatggacgtggagatctggaccaaggagggcgagcggaagaagctgcgcccccgctggctcgacgcccggacctactccgaccccctggccctgaaggagttcaaggacttcgcggccgggcgcaagagcatcgccctcgacctggtgacggagatcggccgggtcccgtcccacctggcccaccgcacccggaacgccctcgacaacctggtgatgctgcacaccagcgagcacgggggccgcgcgtaccggcacgccgtggaggagctccccgagaccatggagacgctgctgctcctggggctgatgatcctcctgaccggcggcgccatgctgttcctcatcagcgggaagggcatcgggaagacctccatcggcctgatctgcgtcatcgtgagctccgggatgctgtggatggccgacgtgcccctccagtggatcgccagcgcgatcgtcctggagttcttcatgatggtgctgctcatcccggagcccgagaagcagcgcacgccccaggacaaccagctggcctacgtggtcatcggcatcctgacgctcgccgccatcgtggccgcgaacgagatgggcctgctggagaccaccaagcgggacctcgggatgtccaaggagcccggcgtggtcagcccgacctcctacctggacgtggacctgcaccccgccagcgcctggacgctctacgccgtggcgaccaccgtcatcacccccatgctgcgccacacgatcgagaactccaccgccaacgtgagcctggccgccatcgccaaccaggcggtggtcctcatggggctggacaagggctggcccatctccaagatggacctgggggtgccgctcctggccctgggctgctacagccaggtgaaccccctcaccctgaccgccgccgtcctgctcctggtgacgcactacgccatcatcggccccgggctgcaggcgaaggccacccgggaggcccagaagcgcaccgccgccggcatcatgaagaaccccaccgtggacgggatcatgacgatcgacctcgacccggtcatctacgactccaagttcgagaagcagctgggccaggtgatgctgctcgtgctgtgcgcggtccagctgctcctgatgcggaccagctgggccctgtgcgaggccctcaccctggccaccggccccatcacgaccctgtgggaggggtcccccggcaagttctggaacgcgaccatcgccgtgagcatggccaacatcttccgcgggtcctacctcgccggcgccgggctggcgttcagcatcatgaagtccgtgggcaccggcaagcgggggacgggcagccagggggagaccctgggcgagaagtggaagaagaagctcaaccagctgagccgccgggagttcgagctgtacaagaagtccgggatcaccgaggtcgaccgcaccgaggccaaggagggcctcaagcggggcgagacgacccaccacgccgtgagccgcgggtccgccaagctgcagtggttcgtggagcggaacatggtcatccccgagggccgcgtgatcgacctggggtgcggccgcgggggctggagctactactgcgccggcctcaagaaggtgaccgaggtccgggggtacaccaagggcgggccgggccacgaggagcccgtgcccatgtccacctacgggtggaacacggtgaagctgatgagcggcaaggacgtcttctacctgcccccggagaagtgcgacaccctgctctgcgacatcggcgagtccagcccctcccccaccgtggaggagagccgcaccatccgggtgctgaagatggtcgagccctggctgaagaacaaccagttctgcatcaaggtgctcaacccgtacatgcccacggtgatcgagcacctggagcgcctgcagcggaagcacgggggcatgctcgtccgcaaccccctgtcccggaacagcacccacgagatgtactggatctccaacgggaccggcaacatcgtgagctccgtgaacatggtcagccgcctgctcctgaaccggttcaccatgacgcaccgccggcccaccatcgagaaggacgtggacctgggcgcggggacccgccacgtcaacgccgagccggagacccccaacatggacgtgatcggcgagcggatcaagcgcatcaaggaggagcactccagcacgtggcactacgacgacgagaacccctacaagacctgggcctaccacgggtcctacgaggtgaaggccaccggcagcgccagctccatgatcaacggggtcgtgaagctcctgaccaagccgtgggacgtggtccccatggtgacgcagatggcgatgaccgacaccacccccttcggccagcagcgggtgttcaaggagaaggtcgacacgcgcacgccccggccgatgcccggcacccgcaaggtgatggagatcaccgccgagtggctgtggcggaccctcgggcgcaacaagcgcccccggctgtgcacccgcgaggagttcaccaagaaggtgcggaccaacgccgccatgggcgcggtcttcacggaggagaaccagtgggagagcgcccgcgccgccgtggaggacgaggagttctggaagctggtggggcgggagcgcgagctccacaagctgggcaagtgcgggtcctgcgtctacaacatgatgggcaagcgggagaagaagctgggcgagttcgggaaggccaagggcagccgcgcgatctggtacatgtggctcggggcccggtacctggagttcgaggccctgggcttcctcaacgaggaccactggttctcccgcgagaacagctactccggggtggagggcgagggcctgcacaagctggggtacatcctccgggacatcagcaagatccccggcggggccatgtacgccgacgacaccgcgggctgggacacccgcatcaccgaggacgacctgcacaacgaggagaagatcacgcagcagatggacccggagcaccggcagctggccaacgccatcttcaagctcacctaccagaacaaggtggtcaaggtgcagcgccccacccccaagggcaccgtgatggacatcatctcccggaaggaccagcgcgggagcggccaggtcgggacgtacggcctgaacaccttcaccaacatggaggcccagctgatccggcagatggagggggagggcgtgctctccaaggccgacctggagaacccccacctcctcgagaagaagatcacccagtggctggagaccaagggcgtggagcgcctgaagcggatggcgatcagcggggacgactgcgtcgtgaagccgatcgacgaccgcttcgccaacgccctcctggccctgaacgacatgggcaaggtgcggaaggacatcccccagtggcagccctccaaggggtggcacgactggcagcaggtccccttctgcagccaccacttccacgagctcatcatgaaggacggccgcaagctggtggtgccgtgccgcccccaggacgagctgatcgggcgggcccgcatctcccagggcgcgggctggagcctcaaggagacggcctgcctggggaaggcctacgcccagatgtggtccctgatgtacttccaccggcgcgacctccggctggcgagcaacgccatctgctccgccgtccccgtgcactgggtgcccaccagccgcaccacctggagcatccacgcccaccaccagtggatgacgaccgaggacatgctgaccgtctggaaccgggtgtggatcgaggacaacccgtggatggaggacaagacccccgtgacgacctgggaggacgtcccctacctcggcaagcgcgaggaccagtggtgcgggtccctgatcggcctgaccagccgggccacctgggcgcagaacatcctcacggccatccagcaggtccgctccctgatcggggacgaggagttcctggactacatgcccagcatgaagcggttccgcaaggaggaggagtccgagggcgccatctggtga

SEQ ID NO: 10344 - RNA, 9873 nt, synthetic construct
  misc_feature 1..9873: note = derived and/or modified CDS sequence (opt1) from DENV-3__KJ622195__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccatcaccgagacccccacctggaaccgcaaggagctgctggtgacgttcaagaacgcccacgcgaagaagcaggaggtcgtggtgctcgggagccaggagggcgccatgcacaccgccctgaccggggccaccgagatccagaactccggcgggacgagcatcttcgccggccacctgaagtgccggctcaagatggacaagctggagctgaagggcatgtcctacgcgatgtgcctcaacaccttcgtcctgaagaaggaggtgagcgagacccagcacgggaccatcctgatcaaggtggagtacaagggcgaggacgccccctgcaagatcccgttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccaccgcccggggcgcccgccggatggcgatcctgggcgacacggcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacctccatgagcttctcctgcatcgtcatcggcatcatcacgctgtacctcgggaccgtggtgcaggccgacatgggctgcgtcatcaactggaagggcaaggagctgaagtgcgggagcggcatcttcgtgaccaacgaggtgcacacctggacggagcagtacaagttccaggcggactcccccaagcgcctggccaccgccatcgccggggcctgggagaacggcgtctgcgggatccgcagcaccacccggatggagaacctcctgtggaagcagatcgcgaacgagctgaactacatcctctgggagaacaacatcaagctgacggtggtggtcggcgacatcatcggcgtgctggagcaggggaagcgcaccctcacgccccagcccatggagctgaagtactcctggaagacctggggcaaggccaagatcgtgacggccgagatccagaacagctccttcatcatcgacgggccgaacacccccgagtgccccagcgcctcccgggcgtggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgccgacatggggtactggatcgagagccagaagaacggctcctggaagctggagaaggcgagcttcatcgaggtgaagacctgcacctggcccaagtcccacaccctctggagcaacggggtcctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtgatcacggagaactgcggcacccgcgggcccagcctccggaccaccacggtctccggcaagctgatccacgagtggtgctgccgcagctgcaccctgccgcccctgcggtacatgggggaggacggctgctggtacggcatggagatccgcccgatcaacgagaaggaggagaacatggtgaagtccctggtgagcgccgggtccggcaaggtcgacaacttcaccatgggggtgctgtgcctcgccatcctgttcgaggaggtgatgcggggcaagttcgggaagaagcacatgatcgcgggcgtcctgctcaccttcatgctgctgctcagcggccagatcacgtggcgcgacatggcccacaccctgatcatgatcgggtccaacgccagcgaccggatgggcatgggggtgacctacctggccctcatcgccaccttcaagatccagcccttcctggcgctgggcttcttcctccgcaagctgacgtcccgggagaacctgctcctgggcgtggggctggccatggccaccaccctccagctgcccgaggacatcgagcagatggccaacggcatcgcgctggggctcatggccctgaagctgatcacccagttcgagacgtaccagctctggaccgccctggtcagcctgacctgcagcaacaccatcttcacgctcaccgtggcctggcgcaccgccaccctgatcctggcgggcgtgtccctcctgcccgtctgccagagctccagcatgcggaagacggactggctgccggtggccgtcgccgccatgggggtgccgcccctccccctgttcatcttctccctgaaggacaccctcaagcgccgcagctggccgctgaacgagggcgtgatggccgtcggcctggtgtccatcctcgcgagctccctgctgcggaacgacgtgcccatggccgggcccctcgtcgccggcgggctgctgatcgcctgctacgtgatcaccggcaccagcgccgacctcacggtggagaaggcggccgacgtcacctgggaggaggaggccgagcagaccggggtgtcccacaacctgatgatcaccgtggacgacgacggcacgatgcgcatcaaggacgacgagaccgagaacatcctgaccgtcctcctgaagaccgccctgctcatcgtgagcggcatcttcccctactccatcccggccaccctgctggtgtggcacacgtggcagaagcagacccagcggagcggggtcctctgggacgtgcccagcccgcccgagacccagaaggcggagctggaggagggcgtgtaccgcatcaagcagcaggggatcttcggcaagacccaggtcggggtgggcgtgcagaaggagggcgtcttccacacgatgtggcacgtgacccgcggggccgtgctgacccacaacggcaagcgcctcgagccgaactgggccagcgtcaagaaggacctgatctcctacgggggcgggtggcggctgagcgcccagtggcagaagggcgaggaggtccaggtgatcgcggtcgagcccggccgcaaccccaagaacttccagaccatgcccgggatcttccagacgaccaccggcgagatcggggccatcgccctggacttcaagccgggcacctccggcagccccatcatcgaccgggaggggaaggtggtgggcctctacgggaacggcgtcgtgacgaagaacgggggctacgtgagcggcatcgcccaggccaacgcggagcccgacgggccgacccccgagctggaggaggagatgttcaagaagcgcaacctgaccatcatggacctccaccccggctccgggaagacccggaagtacctgcccgccatcgtccgcgaggccatcaagcggcgcctgcggacgctcatcctggccccgacccgcgtggtggccgcggagatggaggaggccctgaagggcctccccatccggtaccagaccaccgccaccaagtccgagcacaccgggcgcgagatcgtcgacctgatgtgccacgccaccttcaccatgcggctgctctcccccgtgcgcgtgcccaactacaacctgatcatcatggacgaggcccacttcacggacccggcgagcatcgccgcccggggctacatctccacccgcgtcggcatgggggaggccgcggccatcttcatgaccgccacgccgcccggcacggccgaggccttcccccagagcaacgcgccgatccaggacgaggagcgcgacatccccgagcggtcctggaacagcgggaacgagtggatcaccgacttcgtgggcaagaccgtgtggttcgtcccctccatcaaggccgggaacgacatcgccaactgcctgcgcaagaacggcaagaaggtgatccagctcagccggaagaccttcgacacggagtaccagaagaccaagctgaacgactgggacttcgtggtcaccaccgacatctccgagatgggcgccaacttcaaggccgaccgcgtgatcgacccccggcgctgcctgaagccggtgatcctcacggacgggcccgagcgggtcatcctggcgggccccatgcccgtgaccgccgccagcgccgcccagcgccgggggcgcgtgggccggaacccgcagaaggagaacgaccagtacatcttcaccgggcagcccctgaacaacgacgaggaccacgcgcactggaccgaggccaagatgctcctggacaacatcaacacgcccgagggcatcatccccgccctgttcgagccggagcgcgagaagtccgccgcgatcgacggcgagtaccggctcaagggggagagccgcaagaccttcgtcgagctgatgcggcgcggcgacctgcccgtgtggctcgcccacaaggtcgcctccgaggggatcaagtacaccgaccggaagtggtgcttcgacggcgagcgcaacaaccagatcctggaggagaacatggacgtggagatctggaccaaggagggcgagcggaagaagctgcgcccccgctggctcgacgcccggacctacagcaaccccctggccctgaaggagttcaaggacttcgcggccgggcgcaagtccatcgccctcgacctggtgacggagatcggccgggtcccgagccacctggcccaccgcacccggaacgccctcgacaacctggtgatgctgcacacctccgagcacgggggccgcgcgtaccggcacgccgtggaggagctccccgagaccatggagacgctgctgctcctggggctgatgatcctcctgaccggcggcgccatgctgttcctcatcagcgggaagggcatcgggaagaccagcatcggcctgatctgcgtcatcgtgtccagcgggatgctgtggatggccgacgtgcccctccagtggatcgcctccgcgatcgtcctggagttcttcatgatggtgctgctcatcccggagcccgagaagcagcgcacgccccaggacaaccagctggcctacgtggtcatcggcatcctgacgctcgccgccatcgtggccgcgaacgagatgggcctgctggagaccaccaagcgggacctcgggatgagcaaggagcccggcgtggtctccccgaccagctacctggacgtggacctgcaccccgcctccgcctggacgctctacgccgtggcgaccaccgtcatcacccccatgctgcgccacacgatcgagaacagcaccgccaacgtgtccctggccgccatcgccaaccaggcggtggtcctcatggggctggacaagggctggcccatcagcaagatggacctgggggtgccgctcctggccctgggctgctactcccaggtgaaccccctcaccctgaccgccgccgtcctgctcctggtgacgcactacgccatcatcggccccgggctgcaggcgaaggccacccgggaggcccagaagcgcaccgccgccggcatcatgaagaaccccaccgtggacgggatcatgacgatcgacctcgacccggtcatctacgacagcaagttcgagaagcagctgggccaggtgatgctgctcgtgctgtgcgcggtccagctgctcctgatgcggacctcctgggccctgtgcgaggccctcaccctggccaccggccccatcacgaccctgtgggaggggagccccggcaagttctggaacaccaccatcgcggtgtccatggccaacatcttccgcgggagctacctcgccggcgccgggctggccttctccatcatgaagtccgtgggcacgggcaagcgggggaccggctcccagggggagaccctgggcgagaagtggaagaagaagctcaaccagctgagccgccgggagttcgagctgtacaagaagtccgggatcaccgaggtcgaccgcacggaggcgaaggagggcctcaagcggggcgagaccacccaccacgccgtgtcccgcgggagcgccaagctgcagtggttcgtggagcggaacatggtcatccccgagggccgcgtgatcgacctggggtgcggccgcgggggctggtcctactactgcgccggcctcaagaaggtgaccgaggtccgggggtacaccaagggcgggccgggccacgaggagcccgtgcccatgagcacgtacgggtggaacaccgtgaagctgatgtccggcaaggacgtcttctacctgcccccggagaagtgcgacaccctgctctgcgacatcggcgagagctcccccagccccaccgtggaggagtcccgcacgatccgggtgctgaagatggtcgagccctggctgaagaacaaccagttctgcatcaaggtgctcaacccgtacatgcccaccgtgatcgagcacctggagcgcctgcagcggaagcacgggggcatgctcgtccgcaaccccctgagccggaactccacccacgagatgtactggatcagcaacgggaccggcaacatcgtgtccagcgtgaacatggtctcccgcctgctcctgaaccggttcacgatgacccaccgccggcccaccatcgagaaggacgtggacctgggcgccgggacccgccacgtcaacgcggagccggagacgcccaacatggacgtgatcggcgagcggatcaagcgcatcaaggaggagcacagctccacctggcactacgacgacgagaacccctacaagacctgggcctaccacgggagctacgaggtgaaggccaccggctccgccagcagcatgatcaacggggtcgtgaagctcctgacgaagccgtgggacgtggtccccatggtgacccagatggccatgaccgacaccacgcccttcggccagcagcgggtgttcaaggagaaggtcgacacccgcacgccccggccgatgcccggcacccgcaaggtgatggagatcaccgcggagtggctgtggcggaccctcgggcgcaacaagcgcccccggctgtgcacccgcgaggagttcaccaagaaggtgcggacgaacgccgccatgggcgccgtcttcaccgaggagaaccagtgggagtccgcgcgcgccgccgtggaggacgaggagttctggaagctggtggggcgggagcgcgagctccacaagctgggcaagtgcgggagctgcgtctacaacatgatgggcaagcgggagaagaagctgggcgagttcgggaaggccaagggctcccgcgccatctggtacatgtggctcggggcgcggtacctggagttcgaggccctgggcttcctcaacgaggaccactggttcagccgcgagaactcctacagcggggtggagggcgagggcctgcacaagctggggtacatcctccgggacatctccaagatccccggcggggccatgtacgccgacgacaccgccggctgggacacccgcatcacggaggacgacctgcacaacgaggagaagatcacccagcagatggacccggagcaccggcagctggcgaacgccatcttcaagctcacctaccagaacaaggtggtcaaggtgcagcgccccacccccaagggcacggtgatggacatcatcagccggaaggaccagcgcgggtccggccaggtcgggacctacggcctgaacaccttcaccaacatggaggcccagctgatccggcagatggagggggagggcgtgctcagcaaggccgacctggagaacccccacctcctcgagaagaagatcacccagtggctggagacgaagggcgtggagcgcctgaagcggatggccatctccggggacgactgcgtcgtgaagccgatcgacgaccgcttcgcgaacgccctcctggccctgaacgacatgggcaaggtgcggaaggacatcccccagtggcagcccagcaaggggtggcacgactggcagcaggtccccttctgctcccaccacttccacgagctcatcatgaaggacggccgcaagctggtggtgccgtgccgcccccaggacgagctgatcgggcgggcccgcatcagccagggcgccggctggtccctcaaggagaccgcgtgcctggggaaggcctacgcccagatgtggagcctgatgtacttccaccggcgcgacctccggctggcctccaacgcgatctgcagcgccgtccccgtgcactgggtgcccacctcccgcaccacgtggagcatccacgcccaccaccagtggatgaccaccgaggacatgctgaccgtctggaaccgggtgtggatcgaggacaacccgtggatggaggacaagacgcccgtgaccacctgggaggacgtcccctacctcggcaagcgcgaggaccagtggtgcgggagcctgatcggcctgacctcccgggccacgtgggcccagaacatcctcaccgcgatccagcaggtccgcagcctgatcggggacgaggagttcctggactacatgccctccatgaagcggttccgcaaggaggaggagagcgagggcgccatctggtga

SEQ ID NO: 10345 - RNA, 9873 nt, synthetic construct
  misc_feature 1..9873: note = derived and/or modified CDS sequence (opt1) from DENV-3__KJ622196__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctccccgaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccatcaccgagacccccacctggaaccgcaaggagctgctggtgacgttcaagaacgcccacgcgaagaagcaggaggtcgtggtgctcgggagccaggagggcgccatgcacaccgccctgaccggggccaccgagatccagaactccggcgggacgagcatcttcgccggccacctgaagtgccggctcaagatggacaagctggagctgaagggcatgtcctacgcgatgtgcctcaacaccttcgtcctgaagaaggaggtgagcgagacccagcacgggaccatcctgatcaaggtggagtacaagggcgaggacgccccctgcaagatcccgttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccaccgcccggggcgcccgccggatggcgatcctgggcgacacggcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacctccatgagcttctcctgcatcgtcatcggcatcatcacgctgtacctcgggaccgtggtgcaggccgacatgggctgcgtcatcaactggaagggcaaggagctgaagtgcgggagcggcatcttcgtgaccaacgaggtgcacacctggacggagcagtacaagttccaggcggactcccccaagcgcctggccaccgccatcgccggggcctgggagaacggcgtctgcgggatccgcagcaccacccggatggagaacctcctgtggaagcagatcgcgaacgagctgaactacatcctctgggagaacaacatcaagctgacggtggtggtcggcgacatcatcggcgtgctggagcaggggaagcgcaccctcacgccccagcccatggagctgaagtactcctggaagacctggggcaaggccaagatcgtgacggccgagatccagaacagctccttcatcatcgacgggccgaacacccccgagtgccccagcgcctcccgggcgtggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgccgacatggggtactggatcgagagccagaagaacggctcctggaagctggagaaggcgagcttcatcgaggtgaagacctgcacctggcccaagtcccacaccctctggagcaacggggtcctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtgatcacggagaactgcggcacccgcgggcccagcctccggaccaccacggtctccggcaagctgatccacgagtggtgctgccgcagctgcaccctgccgcccctgcggtacatgggggaggacggctgctggtacggcatggagatccgcccgatcaacgagaaggaggagaacatggtgaagtccctggtgagcgccgggtccggcaaggtcgacaacttcaccatgggggtgctgtgcctcgccatcctgttcgaggaggtgatgcggggcaagttcgggaagaagcacatgatcgcgggcgtcctgctcaccttcatgctgctgctcagcggccagatcacgtggcgcgacatggcccacaccctgatcatgatcgggtccaacgccagcgaccggatgggcatgggggtgacctacctggccctcatcgccaccttcaagatccagcccttcctggcgctgggcttcttcctccgcaagctgacgtcccgggagaacctgctcctgggcgtggggctggccatggccaccaccctccagctgcccgaggacatcgagcagatggccaacggcatcgcgctggggctcatggccctgaagctgatcacccagttcgagacgtaccagctctggaccgccctggtcagcctgacctgcagcaacaccatcttcacgctcaccgtggcctggcgcaccgccaccctgatcctggcgggcgtgtccctcctgcccgtctgccagagctccagcatgcggaagacggactggctgccggtggccgtcgccgccatgggggtgccgcccctccccctgttcatcttctccctgaaggacaccctcaagcgccgcagctggccgctgaacgagggcgtgatggccgtcggcctggtgtccatcctcgcgagctccctgctgcggaacgacgtgcccatggccgggcccctcgtcgccggcgggctgctgatcgcctgctacgtgatcaccggcaccagcgccgacctcacggtggagaaggcggccgacgtcacctgggaggaggaggccgagcagaccggggtgtcccacaacctgatgatcaccgtggacgacgacggcacgatgcgcatcaaggacgacgagaccgagaacatcctgaccgtcctcctgaagaccgccctgctcatcgtgagcggcatcttcccctactccatcccggccaccctgctggtgtggcacacgtggcagaagcagacccagcggagcggggtcctctgggacgtgcccagcccgcccgagacccagaaggcggagctggaggagggcgtgtaccgcatcaagcagcaggggatcttcggcaagacccaggtcggggtgggcgtgcagaaggagggcgtcttccacacgatgtggcacgtgacccgcggggccgtgctgacccacaacggcaagcgcctcgagccgaactgggccagcgtcaagaaggacctgatctcctacgggggcgggtggcggctgagcgcccagtggcagaagggcgaggaggtccaggtgatcgcggtcgagcccggccgcaaccccaagaacttccagaccatgcccgggatcttccagacgaccaccggcgagatcggggccatcgccctggacttcaagccgggcacctccggcagccccatcatcaaccgggaggggaaggtggtgggcctctacgggaacggcgtcgtgacgaagaacgggggctacgtgagcggcatcgcccaggccaacgcggagcccgacgggccgacccccgagctggaggaggagatgttcaagaagcgcaacctgaccatcatggacctccaccccggctccgggaagacccggaagtacctgcccgccatcgtccgcgaggccatcaagcggcgcctgcggacgctcatcctggccccgacccgcgtggtggccgcggagatggaggaggccctgaagggcctccccatccggtaccagaccaccgccaccaagtccgagcacaccgggcgcgagatcgtcgacctgatgtgccacgccaccttcaccatgcggctgctctcccccgtgcgcgtgcccaactacaacctgatcatcatggacgaggcccacttcacggacccggcgagcatcgccgcccggggctacatctccacccgcgtcggcatgggggaggccgcggccatcttcatgaccgccacgccgcccggcacggccgaggccttcccccagagcaacgcgccgatccaggacgaggagcgcgacatccccgagcggtcctggaacagcgggaacgagtggatcaccgacttcgtgggcaagaccgtgtggttcgtcccctccatcaaggccgggaacgacatcgccaactgcctgcgcaagaacggcaagaaggtgatccagctcagccggaagaccttcgacacggagtaccagaagaccaagctgaacgactgggacttcgtggtcaccaccgacatctccgagatgggcgccaacttcaaggccgaccgcgtgatcgacccccggcgctgcctgaagccggtgatcctcacggacgggcccgagcgggtcatcctggcgggccccatgcccgtgaccgccgccagcgccgcccagcgccgggggcgcgtgggccggaacccgcagaaggagaacgaccagtacatcttcaccgggcagcccctgaacaacgacgaggaccacgcgcactggaccgaggccaagatgctcctggacaacatcaacacgcccgagggcatcatccccgccctgttcgagccggagcgcgagaagtccgccgcgatcgacggcgagtaccggctcaagggggagagccgcaagaccttcgtcgagctgatgcggcgcggcgacctgcccgtgtggctcgcccacaaggtcgcctccgaggggatcaagtacaccgaccggaagtggtgcttcgacggcgagcgcaacaaccagatcctggaggagaacatggacgtggagatctggaccaaggagggcgagcggaagaagctgcgcccccgctggctcgacgcccggacctacagcaaccccctggccctgaaggagttcaaggacttcgcggccgggcgcaagtccatcgccctcgacctggtgacggagatcggccgggtcccgagccacctggcccaccgcacccggaacgccctcgacaacctggtgatgctgcacacctccgagcacgggggccgcgcgtaccggcacgccgtggaggagctccccgagaccatggagacgctgctgctcctggggctgatgatcctcctgaccggcggcgccatgctgttcctcatcagcgggaagggcatcgggaagaccagcatcggcctgatctgcgtcatcgtgtccagcgggatgctgtggatggccgacgtgcccctccagtggatcgcctccgcgatcgtcctggagttcttcatgatggtgctgctcatcccggagcccgagaagcagcgcacgccccaggacaaccagctggcctacgtggtcatcggcatcctgacgctcgccgccatcgtggccgcgaacgagatgggcctgctggagaccaccaagcgggacctcgggatgagcaaggagcccggcgtggtctccccgaccagctacctggacgtggacctgcaccccgcctccgcctggacgctctacgccgtggcgaccaccgtcatcacccccatgctgcgccacacgatcgagaacagcaccgccaacgtgtccctggccgccatcgccaaccaggcggtggtcctcatggggctggacaagggctggcccatcagcaagatggacctgggggtgccgctcctggccctgggctgctactcccaggtgaaccccctcaccctgaccgccgccgtcctgctcctggtgacgcactacgccatcatcggccccgggctgcaggcgaaggccacccgggaggcccagaagcgcaccgccgccggcatcatgaagaaccccaccgtggacgggatcatgacgatcgacctcgacccggtcatctacgacagcaagttcgagaagcagctgggccaggtgatgctgctcgtgctgtgcgcggtccagctgctcctgatgcggacctcctgggccctgtgcgaggccctcaccctggccaccggccccatcacgaccctgtgggaggggagccccggcaagttctggaacaccaccatcgcggtgtccatggccaacatcttccgcgggagctacctcgccggcgccgggctggccttctccatcatgaagtccgtgggcacgggcaagcgggggaccggctcccagggggagaccctgggcgagaagtggaagaagaagctcaaccagctgagccgccgggagttcgagctgtacaagaagtccgggatcaccgaggtcgaccgcacggaggcgaaggagggcctcaagcggggcgagaccacccaccacgccgtgtcccgcgggagcgccaagctgcagtggttcgtggagcggaacatggtcatccccgagggccgcgtgatcgacctggggtgcggccgcgggggctggtcctactactgcgccggcctcaagaaggtgaccgaggtccgggggtacaccaagggcgggccgggccacgaggagcccgtgcccatgagcacgtacgggtggaacaccgtgaagctgatgtccggcaaggacgtcttctacctgcccccggagaagtgcgacaccctgctctgcgacatcggcgagagctcccccagccccaccgtggaggagtcccgcacgatccgggtgctgaagatggtcgagccctggctgaagaacaaccagttctgcatcaaggtgctcaacccgtacatgcccaccgtgatcgagcacctggagcgcctgcagcggaagcacgggggcatgctcgtccgcaaccccctgagccggaactccacccacgagatgtactggatcagcaacgggaccggcaacatcgtgtccagcgtgaacatggtctcccgcctgctcctgaaccggttcacgatgacccaccgccggcccaccatcgagaaggacgtggacctgggcgccgggacccgccacgtcaacgcggagccggagacgcccaacatggacgtgatcggcgagcggatcaagcgcatcaaggaggagcacagctccacctggcactacgacgacgagaacccctacaagacctgggcctaccacgggagctacgaggtgaaggccaccggctccgccagcagcatgatcaacggggtcgtgaagctcctgacgaagccgtgggacgtggtccccatggtgacccacatggccatgaccgacaccacgcccttcggccagcagcgggtgttcaaggagaaggtcgacacccgcacgccccggccgatgcccggcacccgcaaggtgatggagatcaccgcggagtggctgtggcggaccctcgggcgcaacaagcgcccccggctgtgcacccgcgaggagttcaccaagaaggtgcggacgaacgccgccatgggcgccgtcttcaccgaggagaaccagtgggagtccgcgcgcgccgccgtggaggacgaggagttctggaagctggtggggcgggagcgcgagctccacaagctgggcaagtgcgggagctgcgtctacaacatgatgggcaagcgggagaagaagctgggcgagttcgggaaggccaagggctcccgcgccatctggtacatgtggctcggggcgcggtacctggagttcgaggccctgggcttcctcaacgaggaccactggttcagccgcgagaactcctacagcggggtggagggcgagggcctgcacaagctggggtacatcctccgggacatctccaagatccccggcggggccatgtacgccgacgacaccgccggctgggacacccgcatcacggaggacgacctgcacaacgaggagaagatcacccagcagatggacccggagcaccggcagctggcgaacgccatcttcaagctcacctaccagaacaaggtggtcaaggtgcagcgccccacccccaagggcacggtgatggacatcatcagccggaaggaccagcgcgggtccggccaggtcgggacctacggcctgaacaccttcaccaacatggaggcccagctgatccggcagatggagggggagggcgtgctcagcaaggccgacctggagaacccccacctcctcgagaagaagatcacccagtggctggagacgaagggcgtggagcgcctgaagcggatggccatctccggggacgactgcgtcgtgaagccgatcgacgaccgcttcgcgaacgccctcctggccctgaacgacatgggcaaggtgcggaaggacatcccccagtggcagcccagcaaggggtggcacgactggcagcaggtccccttctgctcccaccacttccacgagctcatcatgaaggacggccgcaagctggtggtgccgtgccgcccccaggacgagctgatcgggcgggcccgcatcagccagggcgccggctggtccctcaaggagaccgcgtgcctggggaaggcctacgcccagatgtggagcctgatgtacttccaccggcgcgacctccggctggcctccaacgcgatctgcagcgccgtccccgtgcactgggtgcccacctcccgcaccacgtggagcatccacgcccaccaccagtggatgaccaccgaggacatgctgaccgtctggaaccgggtgtggatcgaggacaacccgtggatggaggacaagacgcccgtgaccacctgggaggacgtcccctacctcggcaagcgcgaggaccagtggtgcgggagcctgatcggcctgacctcccgggccacgtgggcccagaacatcctcaccgcgatccagcaggtccgcagcctgatcggggacgaggagttcctggactacatgccctccatgaagcggttccgcaaggaggaggagagcgagggcgccatctggtga

SEQ ID NO: 10346 - RNA, 9873 nt, synthetic construct
  misc_feature 1..9873: note = derived and/or modified CDS sequence (opt1) from DENV-3__KJ830751__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctgggccagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgcggtggtgcaggccgacatggggtgcgtcatcaactggaagggcaaggagctgaagtgcggcagcgggatcttcgtgaccaacgaggtgcacacgtggaccgagcagtacaagttccaggccgactcccccaagcgcctcgccaccgccatcgcgggcgcctgggagaacggggtctgcggcatccgcagcaccacgcggatggagaacctgctgtggaagcagatcgccaacgagctcaactacatcctgtgggagaacaacatcaagctgaccgtggtggtcggggacaccatcggcgtgctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggtctacacccagctgtgcgaccaccggctcatgagcgccgccgtgaaggacgagcgcgcggtgcacgccgacatgggctactggatcgagagccagaagaacgggtcctggaagctggagaaggccagcctgatcgaggtcaagacctgcacgtggccgaagtcccacaccctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcacgaccgtggtcatcaccgagagctgcgggacccgcggcccctccctccggacgaccaccgtgagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtcagcgcgggctccgggaaggtggacaacttcacgatgggcgtgctgtgcctcgccatcctgtacgaggaggtcatgcgggggaagttcggcaagaagcacatgatcgccggggtgttcttcaccttcgtgctgctcctgagcggccagatcacctggcgcaacatggcccacaccctgatcatgatcggctccaacgccagcgaccggatggggatgggcgtcacgtacctcgcgctgatcgccaccttcaagatccagcccttcctggccctcgggttcttcctgcgcaagctgaccagccgggagaacctcctgctgggcgtgggcctcgccatggcgaccacgctgcagctgcccgacgacatcgagcagatggccaacgggatcgccctcggcctgatggccctgaagctcatcacccagttcgagacctaccagctgtggaccgccctggtgtccctcacgtgcagcaacaccatgttcaccctgaccgtcgcgtggcgcacggccaccctgatcctcgccggggtgtccctgctgccggtctgccagagctccagcatgcggaagaccgactggctccccatggccgtggccgcgatgggcgtgccgcccctgccgctgttcatcttcaacctcaaggacaccctgaagcgccgctcctggcccctgaacgagggggtcatggccgtgggcctcgtgagcatcctggcctccagcctgctccggaacgacgtccccatggccggccccctggtggccgggggcctgctcatcgcgtgctacgtgatcacggggacctccgccgacctgaccgtcgagaaggccgccgacgtgacctgggaggaggaggccgagcagacgggcgtgagccacaacctgatgatcaccgtcgacgacgacgggaccatgcgcatcaaggacgacgagatcgagaacatcctcaccgtgctgctgaagaccgcgctcctgatcgtgtccggcatcttcccgtacagcatccccgccacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacccacaacgggaagcgcctggagcccaactgggcgtccgtgaagaaggacctgatcagctacggcgggggctggcggctctccgcccagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcgcagaccaacgccgagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtggtcgcggccgagatggaggaggccctcaaggggctgcccatccgctaccagaccaccgccaccaagtccgagcacacgggccgggagatcgtggacctgatgtgccacgccaccttcaccatgcgcctcctgagccccgtgcgggtcccgaactacaacctgatcatcatggacgaggcgcacttcaccgaccccgcctccatcgccgcccgcgggtacatcagcacgcgggtgggcatgggcgaggcggccgccatcttcatgaccgccacgccgcccgggaccgccgacgcgttcccgcagtccaacgcccccatccaggacgaggagcgcgacatccccgagcgcagctggaactccggcaacgagtggatcacggacttcgccgggaagaccgtgtggttcgtccccagcatcaaggccggcaacgacatcgccaactgcctccggaagaacgggaagaaggtgatccagctgtcccgcaagaccttcgacaccgagtaccagaagacgaagctgaacgactgggacttcgtggtcaccaccgacatcagcgagatgggcgcgaacttcaaggccgaccgggtgatcgacccgcgccggtgcctcaagcccgtgatcctgaccgacggccccgagcgcgtcatcctggccgggcccatgccggtgacggccgcctccgcggcccagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcctcccggcgctgttcgagcccgagcgggagaagtccgccgccatcgacggcgagtaccgcctgaagggcgagtcccggaagaccttcgtcgagctcatgcgccgcggggacctgcccgtgtggctggcccacaaggtcgccagcgagggcatcaagtacacggaccgcaagtggtgcttcgacgggcagcggaacaaccagatcctcgaggagaacatggacgtggagatctggaccaaggagggcgagaagaagaagctgcgcccccggtggctggacgcgcgcacctactccgacccgctcgccctgaaggagttcaaggacttcgccgccggccgcaagagcatcgccctggacctcgtgaccgagatcgggcgggtcccctcccacctggcgcaccgcacgcggaacgccctggacaacctcgtgatgctgcacaccagcgagcacggcgggcgcgcctaccggcacgccgtggaggagctgcccgagaccatggagaccctcctgctgctcggcctgatgatcctgctcaccggcggggccatgctgttcctgatcagcgggaaggggatcggcaagacctccatcgggctcatctgcgtcatcgcgagctccggcatgctgtggatggccgaggtgccgctgcagtggatcgccagcgccatcgtgctcgagttcttcatgatggtcctgctgatccccgagcccgagaagcagcgcacgccccaggacaaccagctcgcctacgtggtgatcgggatcctgaccctggcggccatcatcgccgccaacgagatgggcctcctggagacgaccaagcgggacctgggcatgtccaaggagccgggggtcgtgagccccacctcctacctcgacgtggacctgcaccccgcgagcgcctggaccctgtacgccgtcgccacgaccgtgatcacccccatgctccgccacaccatcgagaactccacggccaacgtgagcctggcggccatcgccaaccaggccgtcgtgctgatgggcctcgacaaggggtggccgatctccaagatggacctgggcgtgcccctgctcgccctggggtgctacagccaggtcaaccccctgaccctcaccgcggccgtgctgctgctcatcacccactacgccatcatcggccccggcctgcaggccaaggccacgcgggaggcgcagaagcgcaccgccgccgggatcatgaagaacccgaccgtggacggcatcatgaccatcgacctggaccccgtcatctacgactccaagttcgagaagcagctcggccaggtgatgctgctggtgctctgcgccgtccagctgctgctcatgcggacgagctgggcgctgtgcgaggccctgaccctcgccaccggccccatcaccacgctgtgggagggctcccccgggaagttctggaacaccaccatcgccgtgagcatggccaacatcttccgcggctcctacctggcgggggccggcctcgccttcagcatcatgaagtccgtggggaccggcaagcggggcacggggagccagggcgagaccctgggggagaagtggaagaagaagctgaaccagctcagccgcaaggagttcgacctgtacaagaagtccggcatcaccgaggtcgaccggaccgaggccaaggaggggctgaagcgcggcgagaccacgcaccacgccgtgagccggggctccgcgaagctccagtggttcgtggagcgcaacatggtcgtgccggaggggcgggtgatcgacctgggctgcgggcgcggcgggtggagctactactgcgccggcctgaagaaggtcaccgaggtgcggggctacaccaagggcgggcccgggcacgaggagcccgtgcccatgtccacctacggctggaacatcgtcaagctcatgagcgggaaggacgtgttctacctgccgcccgagaagtgcgacacgctgctgtgcgacatcggcgagtccagcccctcccccaccgtggaggagagccgcaccatccgcgtcctcaagatggtggagccgtggctgaagaacaaccagttctgcatcaaggtgctgaacccctacatgcccaccgtcatcgagcacctcgagcggctgcagcgcaagcacggcgggatgctggtgcggaaccccctctcccgcaacagcacgcacgagatgtactggatctccaacggcaccgggaacatcgtgagctccgtcaacatggtgagccggctgctgctcaaccgcttcaccatgacccaccggcgcccgacgatcgagaaggacgtggacctgggcgccggcacccggcacgtcaacgccgagcccgagacccccaacatggacgtgatcggggagcgcatcaagcggatcaaggaggagcacaactccacctggcactacgacgacgagaacccgtacaagacgtgggcctaccacggcagctacgaggtcaaggcgaccgggtccgccagcagcatgatcaacggcgtggtgaagctgctcaccaagccctgggacgtcgtgcccatggtgacccagatggccatgacggacaccacccccttcgggcagcagcgcgtcttcaaggagaaggtggacacccggacgccgcgccccatgcccggcacccggaaggtgatggagatcaccgccgagtggctgtggcgcaccctgggccggaacaagcgcccccggctctgcacgcgcgaggagttcaccaagaaggtccgcaccaacgcggccatgggggccgtgttcaccgaggagaaccagtgggactccgccaaggccgcggtggaggacgaggagttctggaagctggtcgaccgggagcgcgagctgcacaagctcggcaagtgcgggagctgcgtgtacaacatgatgggcaagcgggagaagaagctgggggagttcggcaaggccaagggctcccgcgccatctggtacatgtggctgggggcccggtacctcgagttcgaggccctgggcttcctgaacgaggaccactggttcagccgcgagaactcctacagcggggtggagggcgaggggctccacaagctgggctacatcctgcgggacatctccaagatcccgggcggggcgatgtacgccgacgacacggccggctgggacacccgcatcaccgaggacgacctccacaacgaggagaagatcatccagcagatggaccccgagcaccggcagctggccaacgccatcttcaagctgacctaccagaacaaggtcgtgaaggtgcagcgccccacgcccaccgggaccgtcatggacatcatcagccggaaggaccagcgcggctccggccaggtggggacctacggcctcaacaccttcacgaacatggaggcgcagctggtgcggcagatggagggggagggcgtcctgaccaaggccgacctcgagaacagccacctccccgagaagaagatcacccagtggctggagaccaagggggtggagcgcctgaagcggatggccatctccggcgacgactgcgtggtcaagcccatcgacgaccgcttcgccaacgccctggtggcgctgaacgacatgggcaaggtgcggaaggacatcccccagtggcagcccagccgcgggtggcacgactggcagcaggtcccgttctgctcccaccacttccacgagctcatcatgaaggacggccggaagctggtggtgccctgccgcccccaggacgagctgatcgggcgggcccgcatcagccagggcgccgggtggtccctccgcgagacggcctgcctgggcaaggcgtacgcccagatgtggagcctgatgtacttccaccggcgcgacctccggctggcctccaacgccatctgcagcgccgtccccgtgcactgggtgccgacctcccgcaccacctggagcatccacgcgcaccaccagtggatgacgaccgaggacatgctgaccgtctggaaccgggtgtggatcgaggagaacccctggatggaggacaagacccccgtgacgacctgggagaacgtcccctacctcggcaagcgcgaggaccagtggtgcgggagcctgatcggcctgacctcccgggccacctgggcccagaacatcccgacggccatccagcaggtccgcagcctcatcgggaacgaggagttcctggactacatgccctccatgaagcggttccgcaaggaggaggagagcgagggcgccatctggtga

SEQ ID NO: 10347 - RNA, 9873 nt, synthetic construct
  misc_feature 1..9873: note = derived and/or modified CDS sequence (opt1) from DENV-3__KC762681__SS-prME
  source 1..9873: mol_type = other RNA
accagcctgtgcctcatgatgatgctgcccgccaccctggccttccacctcacctcccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacgtggatgagcgcggagggcgcctggcggcaggtcgagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagttcatcgagggcaaggtcgtgcagcacgagaacctcaagtacacggtgatcatcaccgtccacaccggggaccagcaccaggtgggcaacgagacccagggggtcacggccgagatcacgccccaggccagcaccgtggaggccatcctgcccgagtacggcaccctggggctcgagtgcagcccccgcaccggcctggacttcaacgagatgatcctgctcacgatgaagaacaaggcgtggatggtgcaccggcagtggttcttcgacctgccgctgccctggaccagcggcgccaccaccgagacgcccacctggaacaagaaggagctcctggtcaccttcaagaacgcccacgccaagaagcaggaggtggtggtcctggggtcccaggagggcgccatgcacaccgcgctcacgggggccaccgagatccagaccagcggcgggacctccatcttcgccggccacctgaagtgccgcctgaagatggacaagctcgagctgaagggcatgagctacgccatgtgcctgaacgccttcgtgctcaagaaggaggtgtccgagacgcagcacgggaccatcctgatcaaggtcgagtacaagggcgaggacgcgccctgcaagatcccgttcagcaccgaggacgggcagggcaaggcccacaacggccggctgatcaccgccaaccccgtggtgacgaagaaggaggagcccgtcaacatcgaggccgagcccccgttcggggagagcaacatcgtgatcggcatcggggacaaggcgctgaagatcaactggtacaagaagggctccagcatcgggaagatgttcgaggccaccgcccgcggcgcccggcgcatggccatcctcggcgacaccgcgtgggacttcgggtccgtgggcggggtcctgaacagcctgggcaagatggtgcaccagatcttcgggtccgcctacaccgccctcttcagcggcgtgtcctggatcatgaagatcggcatcggggtcctgctgacgtggatcggcctcaacagcaagaacacctccatgagcttctcctgcatcgtgatcgggatcatcaccctgtacctgggcgccgtggtccaggccgacatggggtgcgtgatcaactggaagggcaaggagctcaagtgcggcagcgggatcttcgtgaccaacgaggtccacacgtggaccgagcagtacaagttccaggcggactcccccaagcggctggccaccgccatcgccggcgcctgggagaacggggtgtgcggcatccgcagcaccacgcgcatggagaacctgctctggaagcagatcgcgaacgagctgaactacatcctgtgggagaacaacatcaagctcaccgtggtcgtgggggacatcatcggcgtgctggagcagggcaagcggaccctgacgccccagcccatggacctcaagtactcctggaagacgtgggggaaggccaagatcgtcaccgccgagacccagaacagctccttcatcatcgacggcccgaacacccccgagtgccccagcgcctcccgcgcgtggaacgtgtgggaggtggaggactacgggttcggcgtcttcacgaccaacatctggctgaagctgcgggagatgtacacccagctctgcgaccaccgcctgatgagcgccgccgtgaaggacgagcgggccgtgcacgccgacatgggctactggatcgagagccagaagaacgggtcctggaagctggagaaggcgagcctcatcgaggtcaagacctgcacctggcccaagtcccacacgctgtggagcaacggcgtgctggagtccgacatgatcatccccaagtccctcgccgggcccgtgtcccagcacaactaccgccccggctaccacacccagaccgccgggccgtggcacctgggcaagctggagctcgacttcaactactgcgagggcaccacggtcgtgatcaccgagaactgcgggacccggggccccagcctgcgcaccacgaccgtgtccgggaagctgatccacgagtggtgctgccggagctgcaccctgccgcccctccgctacatgggcgaggacgggtgctggtacggcatggagatccggccgatcaacgagaaggaggagaacatggtcaagtccctggtgagcgccggctccgggaaggtggacaacttcaccatgggcgtcctctgcctggccatcctgttcgaggaggtgatgcgcgggaagttcggcaagaagcacatgatcgcgggggtcctgttcacgttcgtcctgctgctcagcggccagatcacctggcgggacatggcccgcaccctgatcatgatcggctccaacgccagcgaccggatggggatgggcgtgacctacctggccctcatcgccacgttcaagatccagcccttcctggcgctggggttcttcctccgcaagctgacctcccgggagaacctgctcctgggcgtgggcctggccatggccaccaccctccagctgcccgaggacatcgagcagatggccaacgggatcgcgctgggcctcatggccctgaagctgatcacgcagttcgagacctaccagctctggaccgccctggtcagcctgatgtgcagcaacaccatgttcacgctcaccgtggcctggcgcaccgccaccctgatcctggcggggatctccctcctgcccgtctgccagagctccagcatgcggaagacggactggctgccggtgaccgtggccgccatgggcgtgccgcccctccccctgttcatcttctccctgaaggacaccctcaagcgccgcagctggccgctgaacgagggggtgatggccgtgggcctggtctccatcctcgccagctccctgctgcggaacgacgtgcccatggcgggccccctcgtggccgggggcctgctgatcgcctgctacgtcatcaccgggacgagcgccgacctcaccgtggagaaggccgcggacgtgatctgggaggaggaggccgagcagaccggcgtctcccacaacctgatgatcaccgtggacgacgacgggacgatgcgcatcaaggacgacgagaccgagaacatcctgaccgtgctcctgaagaccgccctgctcatcgtcagcggcatcttcccctactccatcccggccaccctgctggtgtggcacacgtggcagaagcagacccagcggagcggcgtgctctgggacgtccccagcccgcccgagacccagaaggccgagctggaggagggggtgtaccgcatcaagcagcagggcatcttcgggaagacccaggtgggcgtcggggtgcagaaggagggcgtgttccacacgatgtggcacgtcacccggggcgcggtgctgacccacaacgggaagcgcctcgagccgaactgggccagcgtgaagaaggacctgatctcctacggcgggggctggcggctgagcgcccagtggcagaagggggaggaggtccaggtgatcgccgtggagcccggcaagaaccccaagaacttccagaccatgcccggcatcttccagacgaccaccggggagatcggcgcgatcgccctggacttcaagccggggacctccggcagccccatcatcaaccgcgagggcaaggtcgtggggctctacggcaacggggtggtcacgaagaacggcgggtacgtgagcggcatcgcccagaccaacgccgagcccgacggcccgacccccgagctggaggaggagatgttcaagaagcggaacctgaccatcatggacctccaccccgggtccggcaagacgcgcaagtacctgcccgccatcgtgcgggaggcgatcaagcgccggctgcgcaccctcatcctggccccgacccgggtcgtggccgccgagatggaggaggccctgaaggggctccccatccgctaccagaccacggcgaccaagagcgcccacaccggcaaggagatcgtggacctgatgtgccacgccaccttcacgatgcggctgctctcccccgtccgcgtgcccaactacaacctgatcatcatggacgaggcccacttcaccgacccggccagcatcgcggcccgggggtacatctccacccgcgtgggcatgggcgaggccgccgcgatcttcatgaccgccacgccgcccgggaccgccgacgccttcccccagagcaacgccccgatccaggacgaggagcgggacatccccgagcgctcctggaacagcggcaacgagtggatcaccgacttcgcggggaagaccgtctggttcgtgccctccatcaaggccggcaacgacatcgccaactgcctgcgcaagaacgggaagaaggtgatccagctcagccggaagacgttcgacaccgagtaccagaagaccaagctgaacgactgggacttcgtcgtgaccacggacatctccgagatgggcgccaacttcaagaccgaccgcgtgatcgacccccggcgctgcctgaagccggtcatcctcaccgacggccccgagcgggtgatcctggccgggcccatgcccgtgaccgtcgcgagcgccgcccagcgccggggccgcgtggggcggaacccgcagaaggagaacgaccagtacatcttcacgggccagcccctgaacaacgacgaggaccacgcccactggaccgaggccaagatgctcctggacaacatcaacacccccgaggggatcatccccgcgctgttcgagccggagcgcgagaagtccgccgccatcgacggcgagtaccggctcaagggcgagagccgcaagaccttcgtcgagctgatgcggcgcggggacctgcccgtgtggctcgcccacaaggtggcgtccgagggcatcaagtacaccgaccggaagtggtgcttcgacggggagcgcaacaaccagatcctggaggagaacatggacgtcgagatctggacgaaggagggcgagaagaagaagctgcggccccgctggctcgacgcccggacctacagcgaccccctggccctgaaggagttcaaggacttcgccgccggccgcaagtccatcgcgctcgacctggtgaccgagatcgggcgcgtgccgagccacctggcccaccggacccgcaacgccctcgacaacctggtcatgctgcacacgtccgagcacggcgggcgggcctaccgccacgccgtggaggagctccccgagaccatggagaccctgctgctcctgggcctgatgatcctcctgaccgggggcgcgatgctgttcctcatcagcggcaaggggatcggcaagacgagcatcgggctgatctgcgtggtcgcctccagcggcatgctgtggatggccgacgtgcccctccagtggatcgcctccgccatcgtgctggagttcttcatgatggtcctgctcatcccggagcccgagaagcagcggacgccccaggacaaccagctggcgtacgtggtgatcgggatcctgaccctcgccgccatcgtcgccgccaacgagatgggcctgctggagaccacgaagcgcgacctcggcatgagcaaggagcccggggtggtgtccccgaccagctacctggacgtcgacctgcaccccgcgtccgcctggaccctctacgccgtggccaccacggtgatcacccccatgctgcggcacaccatcgagaacagcaccgcgaacgtctccctggccgccatcgccaaccaggccgtggtgctcatgggcctggacaaggggtggcccatcagcaagatggacctgggcgtcccgctcctggcgctggggtgctactcccaggtgaaccccctcacgctgaccgccgccgtgctgctcctggtcacccactacgccatcatcggccccggcctgcaggccaaggcgacccgcgaggcccagaagcggacggccgccgggatcatgaagaaccccaccgtggacggcatcatgaccatcgacctcgacccggtgatctacgacagcaagttcgagaagcagctggggcaggtcatgctgctcgtgctgtgcgccgtgcagctgctcctgatgcgcacctcctgggcgttctgcgaggccctgacgctcgccaccggccccatcaccaccctgtgggagggcagccccgggaagttctggaacacgaccatcgccgtctccatggcgaacatcttccggggcagctacctggccggggccggcctcgccttctccatcatgaagtccgtggggaccggcaagcgcggcaccgggagccagggcgagacgctgggggagaagtggaagaagaagctgaaccagctcagccggaaggagttcgacctgtacaagaagtccggcatcaccgaggtggaccgcaccgaggccaaggaggggctgaagcggggcgagatcacccaccacgcggtctcccgcggcagcgccaagctccagtggttcgtggagcggaacatggtgatccccgaggggcgcgtcatcgacctgggctgcgggcggggcgggtggtcctactactgcgccggcctgaagaaggtgaccgaggtgcgcggctacacgaagggcgggccggggcacgaggagcccgtccccatgagcacctacggctggaacatcgtgaagctcatgtccgggaaggacgtgttctacctgcccccggagaagtgcgacaccctgctgtgcgacatcggcgagagctcccccagccccaccgtcgaggagtcccggacgatccgcgtgctcaagatggtggagccctggctgaagaacaaccagttctgcatcaaggtcctgaacccgtacatgcccaccgtgatcgagcacctcgagcgcctgcagcggaagcacggcgggatgctggtgcgcaaccccctcagccggaactccacccacgagatgtactggatcagcaacggcaccgggaacatcgtctccagcgtgaacatggtctcccgcctgctgctcaaccggttcacgatgacccaccgccggcccaccatcgagaaggacgtggacctgggcgccggcacccgccacgtgaacgccgagccggagacgcccaacatggacgtcatcggggagcggatccgccggatcaaggaggagcacagctccacctggcactacgacgaggagaacccctacaagacctgggcgtaccacggcagctacgaggtgaaggccaccgggtccgccagcagcatgatcaacggcgtggtcaagctgctcacgaagccgtgggacgtggtgcccaccgtcacccagatggccatgaccgacacgacccccttcgggcagcagcgcgtgttcaaggagaaggtggacacccggacgccccgcccgatgcccggcacccggaaggccatggagatcaccgcggagtggctgtggcgcaccctgggccggaacaagcgcccccggctctgcacccgcgaggagttcacgaagaaggtccgcaccaacgccgccatgggggccgtgttcaccgaggagaaccagtgggactccgcgcgggccgccgtggaggacgaggagttctggaagctggtcgaccgcgagcgggagctgcacaagctcggcaagtgcgggagctgcgtgtacaacatgatgggcaagcgcgagaagaagctgggggagttcggcaaggccaagggctcccgggccatctggtacatgtggctgggggcgcgctacctcgagttcgaggccctgggcttcctgaacgaggaccactggttcagccgggagaactccttcagcggggtggagggcgaggggctccacaagctgggctacatcctgcgcgacatctccaagatccccggcggggccatgtacgccgacgacaccgccggctgggacacgcggatcaccgaggacgacctccacaacgaggagaagatcacccagcagatggacccggagcaccgccagctggcgaacgccatcttcaagctgacctaccagaacaaggtcgtgaaggtgcagcggcccacgcccaaggggaccgtcatggacatcatcagccgcaaggaccagcggggctccggccaggtggggacctacggcctcaacaccttcaccaacatggaggtgcagctgatccgccagatggagggggagggcgtcctgagcaaggccgacctcgagaacccccacctcctggagaaggagatcacgcagtggctcgagaccaagggggtggagcggctgaagcgcatggccatctccggcgacgactgcgtggtcaagccgatcgacgaccggttcgccgacgcgctgctcgccctgaacgacatgggcaaggtgcgcaaggacatcccccagtggcagcccagcaaggggtggcacgactggcagcaggtccccttctgctcccaccacttccacgagctgatcatgaaggacggccggaagctcgtcgtgccgtgccgcccccaggacgagctgatcgggcgggcccgcatcagccagggcgccgggtggtccctgaaggagaccgcctgcctcggcaaggcgtacgcccagatgtgggccctgatgtacttccaccgccgggacctgcgcctcgccagcaacgcgatctgctccgccgtgcccgtccactgggtgcccaccagccggacgacctggtccatccacgcccaccaccagtggatgaccaccgaggacatgctgacggtgtggaaccgcgtctggatcgaggacaacccgtggatggaggacaagacccccgtgaccacctgggaggacgtgccctacctgggcaagcgggaggaccagtggtgcgggagcctcatcggcctggccagccgcgccacgtgggcgcagaacatcctgaccgccatccagcaggtccggtccctcatcgggaacgaggagttcctggactacatgcccagcatgaagcgcttccggaaggaggaggagtccgagggcgccatctggtga

SEQ ID NO: 10348 - RNA, 9873 nt, synthetic construct
  misc_feature 1..9873: note = derived and/or modified CDS sequence (opt1) from DENV-3__KC762684__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcgcgcagacctggatgagcgccgagggcgcctggcggcaggtcgagaaggtggagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgagcatcacggtccacaccggggaccagcaccaggtgggcaacgagacccagggggtcaccgccgagatcacgccccaggcctccaccgtggaggcgatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccaccaccgagacccccacgtggaacaagaaggagctgctggtcaccttcaagaacgcccacgccaagaagcaggaggtggtggtcctcgggagccaggagggcgcgatgcacaccgccctgaccggggccacggagatccagacctccggcgggaccagcatcttcgccggccacctgaagtgccgcctcaagatggacaagctggagctgaagggcatgtcctacgccatgtgcagcaacgcgttcgtgctcaagaaggaggtgagcgagacccagcacgggacgatcctgatcaaggtcgagtacaagggcgaggacgccccctgcaagatccccttctccaccgaggacgggcagggcaaggcccacaacggccggctgatcaccgccaaccccgtggtgaccaagaaggaggagcccgtcaacatcgaggcggagcccccgttcggggagagcaacatcatcatcggcatcggggacaaggccctgaagatcaactggtacaagaagggctccagcatcgggaagatgttcgaggccacggcccgcggcgcccggcgcatggcgatcctcggcgacaccgcctgggacttcgggtccgtgggcggggtgctgaacagcctgggcaagatggtccaccagatcttcgggtccgcctacaccgccctcttcagcggcgtgtcctggatcatgaagatcggcatcggggtgctgctgacctggatcggcctcaacagcaagaacacgtccatgagcttctcctgcatcgtcatcgggatcatcaccctgtacctgggcgccgtggtgcaggcggacatggggtgcgtcatcaactggaagggcaaggagctcaagtgcggcagcgggatcttcgtgaccaacgaggtgcacacctggacggagcagtacaagttccaggccgactcccccaagcggctggccaccgccatcgccggcgcgtgggagaacggggtctgcggcatccgcagcaccacccgcatggagaacctgctctggaagcagatcgccaacgagctgaactacatcctgtgggagaacaacatcaagctcacggtggtggtcggggacatcatcggcatcctggagcagggcaagcggaccctgacgccccagcccatggagctcaagtactcctggaagacctgggggaaggccaagatcgtgacggccgagatgcagaacagctccttcatcatcgacggcccgaacacccccgagtgccccaacgcgagccgcgcctggaacgtgtgggaggtcgaggactacgggttcggcgtgttcaccaccaacatctggctgaagctgcgggagatgtacacgcagctctgcgaccaccgcctgatgagcgccgccatcaaggacgagcgggccgtgcacgcggacatgggctactggatcgagtcccagaagaacgggagctggaagctggagaaggcctccctcatcgaggtcaagacctgcacctggcccaagagccacaccctgtggtccaacggcgtgctggagagcgacatgatcatcccgaagtccctcgccgggcccatcagccagcacaactaccgccccggctaccacacccagacggccgggccgtggcacctgggcaagctggagctcgacttcaactactgcgagggcaccaccgtggtcatcaccgagaactgcgggacgcggggcccctccctgcgcaccaccaccgtgagcgggaagctgatccacgagtggtgctgccggtcctgcacgctgccgcccctccgctacatgggcgaggacgggtgctggtacggcatggagatccggccgatcaacgagcgcgaggagaacatggtcaagagcctggtgtccgccggcagcgggaaggtggacaacttcaccatgggcgtgctctgcctggcgatcctgttcgaggaggtcatgcgggggaagttcggcaagaagcacatgatcgccggggtgttcttcaccttcgtgctcctgctgtccggccagatcacctggcgcgacatggcccggacgctcatcatgatcggcagcaacgcctccgaccgcatggggatgggcgtcacctacctggccctgatcgcgaccttcaagatccagcccttcctcgccctggggttcttcctgcggaagctcaccagccgcgagaacctgctgctcggcgtgggcctggccatggccacgaccctgcagctccccgaggacatcgagcagatggcgaacgggatcgccctgggcctgatggccctcaagctggtgacccagttcgagacctaccagctgtggacggccctcgtcagcctgatgtgctccaacaccatcttcaccctgaccgtggcctggcggacggcgaccctcatcctggccgggatcagcctgctccccctgtgccagtccagcggcatgcgcaagaccgactggctgccgatgaccgtggccgccatgggggtgccgcccctgcccctgttcatcttctccctgaaggacacgctcaagcgccggagctggccgctgaacgagggcgtgatggccgtcggcctggtgtccatcctcgcgagctccctgctgcgcaacgacgtgcccatggccgggcccctcgtcgccggcgggctgctgatcgcctgctacgtgatcaccggcaccagcgccgacctcaccgtggagaaggcggccgacgtcacgtgggaggaggaggccgagcagaccggggtgtcccacaacctgatgatcaccgtggacgacgacggcaccatgcggatcaaggacgacgagacggagaacatcctgaccgtcctcctgaagaccgccctgctcatcgtgagcggcatcttcccctactccatcccggccaccctgctggtgtggcacacctggcagaagcagacgcagcgcagcggggtcctctgggacgtgcccagcccgcccgagacccagaaggcggagctggaggagggcgtgtaccggatcaagcagcaggggatcttcggcaagacccaggtcggggtgggcgtgcagaaggagggcgtcttccacaccatgtggcacgtgacgcgcggggccgtgctgacctacaacggcaagcggctcgagccgaactgggccagcgtcaagaaggacctgatctcctacgggggcgggtggcgcctgagcgcccagtggcagaagggcgaggaggtccaggtgatcgcggtcgagcccggcaagaaccccaagaacttccagaccatgcccgggatcttccagaccacgaccggcgagatcggggccatcgccctggacttcaagccgggcacctccggcagccccatcatcaaccgggaggggaaggtggtgggcctctacgggaacggcgtcgtgaccaagaacgggggctacgtgagcggcatcgcccagacgtccgccgagcccgacgggccgacccccgagctggaggaggagatgttcaagaagcgcaacctgaccatcatggacctccaccccggcagcgggaagacccggaagtacctgcccgcgatcgtccgcgaggccatcaagcggcgcctgcggacgctcatcctggccccgacccgcgtggtggccgccgagatggaggaggcgctgaagggcctccccatccggtaccagaccaccgccacgaagtccgagcacaccgggaaggagatcgtcgacctgatgtgccacgccaccttcaccatgcgcctgctcagccccgtgcgggtgcccaactacaacctgatcatcatggacgaggcccacttcacggacccggcctccatcgcggcccgcggctacatcagcacccgggtcggcatgggggaggccgccgcgatcttcatgaccgccacgccgcccggcacggccgacgccttcccccagtccaacgccccgatccaggacgaggagcgcgacatccccgagcgcagctggaactccgggaacgactggatcaccgacttcgcgggcaagaccgtgtggttcgtgcccagcatcaaggccgggaacgacatcgccaactgcctgcggaagaacggcaagaaggtcatccagctctcccgcaagaccttcgacacggagtaccagaagaccaagctgaacgactgggacttcgtggtgaccaccgacatcagcgagatgggcgccaacttcaaggccgaccgggtcatcgacccccgccggtgcctgaagccggtgatcctcacggacgggcccgagcgcgtgatcctggcgggccccatgcccgtcaccgtggcctccgccgcccagcggcgcgggcgggtgggccgcaacccgcagaaggagaacgaccagtacatcttcaccgggcagcccctgaacaacgacgaggaccacgcccactggaccgaggcgaagatgctcctggacaacatcaacacgcccgagggcatcatccccgccctgttcgagccggagcgggagaagtccgccgccatcgacggcgagtaccgcctcaagggggagtcccggaagaccttcgtcgagctgatgcgccggggcgacctgcccgtgtggctcgcgcacaaggtggccagcgaggggatcaagtacaccgaccgcaagtggtgcttcgacggcgagcggaacaaccagatcctggaggagaacatggacgtcgagatctggaccaaggagggcgagaagaagaagctgcgcccccggtggctcgacgcccgcacctactccgaccccctggccctgaaggagttcaaggacttcgccgcggggcgcaagagcatcgccctcgacctggtgacggagatcggccgggtcccgtcccacctggcccaccgcacccggaacgccctcgacaacctggtgatgctgcacaccagcgagcacgggggccgcgcctaccggcacgcggtggaggagctccccgagaccatggagacgctgctgctcctggggctgatgatcctcctgaccggcggcgtcatgctgttcctcatcagcgggaagggcgtggggaagacctccatcggcctgatctgcgtggtcgccagctccagcatgctgtggatggccgacatccccctccagtggatcgcctccgccatcgtgctggagttcttcatgatggtgctgctcatcccggagcccgagaagcagcgcacgccccaggacaaccagctggcgtacgtcgtgatcgggatcctgacgctcgccgccatcgtggccgccaacgagatgggcctgctggagaccaccaagcgggacctcggcatgagcaaggagcccggggtcgtgtccccgaccagctacctggacgtggacctgcaccccgcgtccgcctggacgctctacgccgtcgccaccaccgtgatcacccccatgctgcgccacacgatcgagaacagcaccgcgaacgtgtccctggccgccatcgccaaccaggccgtcgtgctcatgggcctggacaaggggtggcccatcagcaagatggacctgggcgtgccgctcctggcgctggggtgctactcccaggtcaaccccctcaccctgaccgccgccgtgctgctcctggtgacgcactacgccatcatcggccccggcctgcaggccaaggcgacccgggaggcccagaagcgcaccgccgccgggatcatgaagaaccccaccgtcgacggcatcatgacgatcgacctcgacccggtgatctacgacagcaagttcgagaagcagctgggccaggtgatgctgctcgtcctgtgcgccgtgcagctgctcctgatgcggacctcctgggcgttctgcgaggccctgaccctcgccaccggccccatcacgaccctgtgggagggcagccccgggaagttctggaacaccaccatcgccgtgtccatggcgaacatcttccgcggcagctacctggccggggccggcctcgccttctccatcatgaagtccgtcgggacgggcaagcggggcaccgggagccagggcgagaccctgggggagaagtggaagaagaagctgaaccagctctcccgcaaggagttcgacctgtacaagaagtccggcatcaccgaggtggaccggacggaggccaaggaggggctgaagcgcggcgagatcacccaccacgcggtgtcccggggcagcgccaagctccagtggttcgtcgagcgcaacatggtgatccccgaggggcgggtgatcgacctgggctgcgggcgcggcgggtggtcctactactgcgccggcctgaagaaggtcaccgaggtgcggggctacaccaagggcgggccggggcacgaggagcccgtgcccatgagcacctacggctggaacatcgtcaagctcatgtccgggaaggacgtgttctacctgcccccggagaagtgcgacacgctgctgtgcgacatcggcgagagctcccccagccccaccgtggaggagtcccgcaccatccgcgtcctcaagatggtggagccctggctgaagaacaaccagttctgcatcaaggtgctgaacccgtacatgcccgccgtcatcgagcacctcgagcggctgcagcgcaagcacggcgggatgctggtgcggaaccccctcagccgcaactccacccacgagatgtactggatcagcaacggcacggggaacatcgtgtccagcgtcaacatggtgtcccggctgctgctcaaccgcttcaccatgacctaccggcgccccaccatcgagaaggacgtggacctgggcgccggcacgcggcacgtcaacgcggagccggagacccccaacatggacgtgatcggggagcgcatccggcgcatcaaggaggagcacagctccacctggcactacgacgacgagaacccctacaagacctgggcctaccacggcagctacgaggtcaaggccacggggagcgcctccagcatgatcaacggcgtggtgaagctgctcaccaagccgtgggacgtcgtgcccaccgtgacccagatggccatgacggacaccacccccttcgggcagcagcgggtcttcaaggagaaggtggacacccgcacgcccaagccgatgcccggcacccggaaggtgatggagatcaccgcggagtggctgtggcgcaccctgggccggaacaagcgcccccggctctgcacgcgcgaggagttcaccaagaaggtccgcaccaacgccgccatgggggccgtgttcaccgaggagaaccagtgggactccgcgcgggccgccgtggaggacgaggagttctggaagctggtcgaccgcgagcgggagctgcacaagctcggcaagtgcgggagctgcgtgtacaacatgatgggcaagcgcgagaagaagctgggggagttcggcaaggccaagggctcccgggccatctggtacatgtggctgggggcgcgctacctcgagttcgaggccctgggcttcctgaacgaggaccactggttcagccgggagaactcctacagcggggtggagggcgaggggctccacaagctgggctacatcctgcgcgacatctccaagatccccggcggggccatgtacgccgacgacacggccggctgggacacccggatcaccgaggacgacctccacaacgaggagaagatcacccagcagatggacccggagcaccgccagctggcgaacgccatcttcaagctgacgtaccagaacaaggtcgtgaaggtgcagcggcccacccccaaggggaccgtcatggacatcatcagccgcaaggaccagcggggctccggccaggtggggacctacggcctcaacacgttcaccaacatggaggcccagctgatccgccagatggagggggagggcgtgctgagcaagaccgacctcgagaacccccacctcctggagaagaagatcacccagtggctcgagaccaagggggtcgagcggctgaagcgcatggccatctccggcgacgactgcgtggtgaagccgatcgacgaccggttcgccaacgcgctgctcgccctgaacgacatgggcaaggtccgcaaggacatcccccagtggcagcccagcaaggggtggcacgactggcagcaggtccccttctgctcccaccacttccacgagctgatcatgaaggacggccggaagctcgtggtcccgtgccgcccccaggacgagctgatcgggcgggcccgcatcagccagggcgccgggtggtccctgaaggagacggcctgcctcggcaaggcgtacgcccagatgtgggccctgatgtacttccaccgccgggacctgcgcctcgccagcaacgcgatctgctccgccgtgcccgtgcactgggtccccaccagccggaccacctggagcatccacgcccaccaccagtggatgacgaccgaggacatgctgaccgtgtggaaccgcgtgtggatcgaggacaacccgtggatggaggacaagacccccgtcacgacctgggaggacgtgccctacctgggcaagcgggaggaccagtggtgcgggtccctcatcggcctgaccagccgcgccacctgggcccagaacatcctgacggcgatccagcaggtccggtccctcatcgggaacgaggagttcctggactacatgcccagcatgaagcgcttccggaaggaggaggagtccgagggcgccatctggtga

SEQ ID NO: 10349 - RNA, 9873 nt, synthetic construct
  misc_feature 1..9873: note = derived and/or modified CDS sequence (opt1) from DENV-3__KC762686__SS-prME
  source 1..9873: mol_type = other RNA
accagcctgtgcctcatgatgatgctgcccgccaccctggccttccacctcacctcccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacgtacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtggagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagttcatcgagggcaaggtcgtgcagcacgagaacctcaagtacaccgtgatcatcacggtccacaccggggaccagcaccaggtgggcaacgagacccagggggtcaccgccgagatcacgccccaggccagcaccgtggaggcgatcctgcccgagtacggcaccctggggctcgagtgcagcccccggaccggcctggacttcaacgagatgatcctgctcaccatgaagaacaaggcctggatggtgcaccggcagtggttcttcgacctgccgctgccctggacgagcggcgccaccaccgagacccccacgtggaacaagaaggagctcctggtcaccttcaagaacgcccacgccaagaagcaggaggtggtggtcctggggtcccaggagggcgcgatgcacaccgccctcaccggggccacggagatccagaccagcggcgggacctccatcttcgccggccacctgaagtgccgcctgaagatggacaagctcgagctgaagggcatgagctacgccatgtgcctgaacgcgttcgtgctcaagaaggaggtgtccgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccatcaacatcgaggcggagcccccgttcggggagagcaacatcgtcatcggcatcggggacaaggccctgaagatcaactggtacaagaagggctccagcatcgggaagatgttcgaggccacggcccgcggcgcccggcgcatggcgatcctcggcgacaccgcctgggacttcgggtccgtgggcggggtgctgaacagcctgggcaagatggtccaccagatcttcgggtccgcctacaccgccctcttcagcggcgtgtcctggatcatgaagatcggcatcggggtgctgctgacctggatcggcctcaacagcaagaacacgtccatgagcttctcctgcatcgtcatcgggatcatcaccctgtacctgggcgccgtggtgcaggcggacatggggtgcgtcatcaactggaagggcaaggagctcaagtgcggcagcgggatcttcgtgaccaacgaggtgcacacctggacggagcagtacaagttccaggccgactcccccaagcggctggccaccaccatcgccggcgcctgggagaacggggtctgcggcatccgcagcaccacgcgcatggagaacctgctctggaagcagatcgcgaacgagctgaactacatcctgtgggagaacaacatcaagctcaccgtggtggtcggggacatcatcggcgtgctggagcagggcaagcggaccctgacgccccagcccatggagctcaagtactcctggaagacgtgggggaaggccaagatcgtgaccgccgagacccagaacagctccttcatcatcgacggcccgaacacccccgagtgccccagcgcctcccgcgcgtggaacgtctgggaggtggaggactacgggttcggcgtgttcacgaccaacatctggctgaagctgcgggagatgtacacccagctctgcgaccaccgcctgatgagcgccgccgtcaaggacgagcgggccgtgcacgccgacatgggctactggatcgagagccagaagaacgggtcctggaagctggagaaggcgagcctcatcgaggtgaagacctgcacctggcccaagtcccacacgctgtggagcaacggcgtcctggagtccgacatgatcatccccaagtccctcgccgggcccgtgtcccagcacaaccaccgccccggctaccacacccagaccgccgggccgtggcacctgggcaagctggagctcgacttcaactactgcgagggcaccacggtggtcatcaccgagaactgcgggacccggggccccagcctgcgcaccacgaccgtgtccgggaagctgatccacgagtggtgctgccggagctgcaccctgccgcccctccgctacatgggcgaggacgggtgctggtacggcatggagatccggccgatcaacgagaaggaggagaacatggtgaagtccctggtcagcgccggctccgggaaggtggacaacttcaccatgggcgtgctctgcctggccatcctgttcgaggaggtcatgcgcgggaagttcggcaagaagcacatgatcgcgggggtcctgttcacgttcgtgctgctgctcagcggccagatcacctggcgggacatggcccgcaccctgatcatgatcggctccaacgccagcgaccggatggggatgggcgtcacctacctggccctcatcgccacgttcaagatccagcccttcctggcgctggggttcttcctccgcaagctgacctcccgggagaacctgctcctgggcgtgggcctggccatggccaccaccctccagctgcccgaggacatcgagcagatggccaacgggatcgcgctgggcctcatggccctgaagctgatcacgcagttcgagacctaccagctctggaccgccctggtgagcctgatgtgcagcaacaccatcttcacgctcaccgtcgcctggcgcaccgccaccctgatcctggcggggatctccctcctgcccgtgtgccagagctccagcatgcggaagacggactggctgccggtcaccgtggccgccatgggcgtgccgcccctccccctgttcatcttctccctgaaggacaccctcaagcgccgcagctggccgctgaacgagggggtcatggccgtgggcctggtgtccatcctcgccagctccctgctgcggaacgacgtccccatggcgggccccctcgtggccgggggcctgctgatcgcctgctacgtgatcaccgggacgagcgccgacctcaccgtcgagaaggccgcggacgtgatctgggaggaggaggccgagcagaccggcgtgtcccacaacctgatgatcaccgtcgacgacgacgggacgatgcgcatcaaggacgacgagaccgagaacatcctgaccgtgctcctgaagaccgccctgctcatcgtgagcggcatcttcccctactccatcccggccaccctgctggtctggcacacgtggcagaagcagacccagcggagcggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctgacccacaacgggaagcgcctcgagccgaactgggccagcgtgaagaaggacctgatctcctacggcgggggctggcggctgagcgcccagtggcagaagggggaggaggtgcaggtcatcgccgtggagcccggcaagaaccccaagaacttccagaccatgcccggcatcttccagacgaccaccggggagatcggcgcgatcgccctggacttcaagccggggacctccggcagccccatcatcaaccgcgagggcaaggtggtcgggctctacggcaacggggtggtgacgaagaacggcgggtacgtcagcggcatcgcccagaccaacgccgagcccgacggcccgacccccgagctggaggaggagatgttcaagaagcggaacctgaccatcatggacctccaccccgggtccggcaagacgcgcaagtacctgcccgccatcgtgcgggaggcgatcaagcgccggctgcgcaccctcatcctggccccgacccgggtggtcgccgccgagatggaggaggccctgaaggggctccccatccgctaccagaccacggcgaccaagagcgcccacaccggcaaggagatcgtggacctgatgtgccacgccaccttcacgatgcggctgctctcccccgtgcgcgtccccaactacaacctgatcatcatggacgaggcccacttcaccgacccggccagcatcgcggcccgggggtacatctccacccgcgtgggcatgggcgaggccgccgcgatcttcatgaccgccacgccgcccgggaccgccgacgccttcccccagagcaacgccccgatccaggacgaggagcgggacatccccgagcgctcctggaacagcggcaacgagtggatcaccgacttcgcggggaagaccgtgtggttcgtcccctccatcaaggccggcaacgacatcgccaactgcctgcgcaagaacgggaagaaggtgatccagctcagccggaagacgttcgacaccgagtaccagaagaccaagctgaacgactgggacttcgtggtcaccacggacatctccgagatgggcgccaacttcaaggccgaccgcgtgatcgacccccggcgctgcctgaagccggtgatcctcaccgacggccccgagcgggtcatcctggcggggcccatgcccgtgaccgtggccagcgccgcccagcgccggggccgcgtcgggcggaacccgcagaaggagaacgaccagtacatcttcaccggccagcccctgaacaacgacgaggaccacgcccactggacggaggcgaagatgctcctggacaacatcaacacccccgaggggatcatccccgccctgttcgagccggagcgcgagaagtccgccgccatcgacggcgagtaccggctcaagggcgagagccgcaagaccttcgtggagctgatgcggcgcggggacctgcccgtctggctcgcgcacaaggtggcctccgagggcatcaagtacaccgaccggaagtggtgcttcgacggggagcgcaacaaccagatcctggaggagaacatggacgtggagatctggaccaaggagggcgagaagaagaagctgcggccccgctggctcgacgcccggacgtacagcgaccccctggccctgaaggagttcaaggacttcgccgcgggccgcaagtccatcgccctcgacctggtcaccgagatcgggcgcgtgccgagccacctggcccaccggacccgcaacgccctcgacaacctggtgatgctgcacacctccgagcacggcgggcgggcctaccgccacgcggtcgaggagctccccgagacgatggagaccctgctgctcctgggcctgatgatcctcctgaccgggggcgccatgctgttcctcatcagcggcaaggggatcggcaagaccagcatcgggctgatctgcgtggtggcctccagcggcatgctgtggatggccgacgtccccctccagtggatcgcctccgcgatcgtgctggagttcttcatgatggtgctgctcatcccggagcccgagaagcagcggacgccccaggacaaccagctggcctacgtcgtgatcgggatcctgaccctcgccgccatcgtggccgcgaacgagatgggcctgctggagaccaccaagcgcgacctcggcatgagcaaggagcccggggtcgtgtccccgacgagctacctggacgtggacctgcaccccgcctccgcctggaccctctacgccgtcgcgaccaccgtgatcacgcccatgctgcggcacaccatcgagaacagcaccgccaacgtgtccctggccgccatcgccaaccaggcggtcgtgctcatgggcctggacaaggggtggcccatcagcaagatggacctgggcgtgccgctcctggccctggggtgctactcccaggtcaaccccctcaccctgacggccgccgtgctgctcctggtgacccactacgccatcatcggccccggcctgcaggcgaaggccacccgcgaggcccagaagcggaccgccgccgggatcatgaagaaccccacggtcgacggcatcatgaccatcgacctcgacccggtgatctacgacagcaagttcgagaagcagctgggccaggtgatgctgctcgtcctgtgcgcggtgcagctgctcctgatgcgcacctcctgggccttctgcgaggccctgaccctcgccacgggccccatcaccaccctgtgggagggcagccccgggaagttctggaacaccacgatcgcggtgtccatggccaacatcttccggggcagctacctggccggggccggcctcgccttctccatcatgaagtccgtcgggaccggcaagcgcggcaccgggagccagggcgagaccctgggggagaagtggaagaagaagctgaaccagctcagccggaaggagttcgacctgtacaagaagtccggcatcacggaggtggaccgcaccgaggcgaaggaggggctgaagcggggcgagatcacccaccacgccgtgtcccgcggcagcgccaagctccagtggttcgtcgagcggaacatggtgatccccgaggggcgcgtgatcgacctgggctgcgggcggggcgggtggtcctactactgcgccggcctgaagaaggtcaccgaggtgcgcggctacaccaagggcgggccggggcacgaggagcccgtgcccatgagcacgtacggctggaacatcgtcaagctcatgtccgggaaggacgtgttctacctgcccccggagaagtgcgacaccctgctgtgcgacatcggcgagagctcccccagccccaccgtggaggagtcccggaccatccgcgtcctcaagatggtggagccctggctgaagaacaaccagttctgcatcaaggtgctgaacccgtacatgcccacggtcatcgagcacctcgagcgcctgcagcggaagcacggcgggatgctggtgcgcaaccccctcagccggaactccacccacgagatgtactggatcagcaacggcaccgggaacatcgtgtccagcgtcaacatggtgtcccgcctgctgctcaaccggttcaccatgacgcaccgccggcccaccatcgagaaggacgtcgacctgggcgccggcacccgccacgtgaacgcggagccggagacccccaacatggacgtgatcggggagcggatccgccggatcaaggaggagcacagctccacgtggcactacgacgaggagaacccctacaagacctgggcctaccacggcagctacgaggtcaaggccaccgggtccgccagcagcatgatcaacggcgtggtgaagctgctcaccaagccgtgggacgtcgtgcccacggtgacccagatggccatgaccgacaccacgcccttcgggcagcagcgcgtcttcaaggagaaggtggacacccggacgccccgcccgatgcccggcacccggaaggcgatggagatcaccgccgagtggctgtggcgcaccctgggccggaacaagcgcccccggctctgcacccgcgaggagttcaccaagaaggtgcgcacgaacgccgccatgggggcggtcttcaccgaggagaaccagtgggactccgcccgggccgccgtggaggacgaggagttctggaagctggtggaccgcgagcgggagctgcacaagctcggcaagtgcgggagctgcgtctacaacatgatgggcaagcgcgagaagaagctgggggagttcggcaaggccaagggctcccgggcgatctggtacatgtggctgggggcccgctacctcgagttcgaggccctgggcttcctgaacgaggaccactggttcagccgggagaactccttcagcggggtggagggcgaggggctccacaagctgggctacatcctgcgcgacatctccaagatccccggcggggccatgtacgccgacgacaccgcgggctgggacacccggatcacggaggacgacctccacaacgaggagaagatcacccagcagatggagccggagcaccgccagctggccaacgccatcttcaagctgacctaccagaacaaggtggtcaaggtgcagcggcccacccccaaggggacggtgatggacatcatcagccgcaaggaccagcggggctccggccaggtcgggacctacggcctcaacaccttcaccaacatggaggtgcagctgatccgccagatggagggggagggcgtgctgagcaaggccgacctcgagaacccccacctcctggagaaggagatcacccagtggctcgagacgaagggggtcgagcggctgaagcgcatggccatctccggcgacgactgcgtggtgaagccgatcgacgaccggttcgcggacgccctgctcgccctgaacgacatgggcaaggtccgcaaggacatcccccagtggcagcccagcaaggggtggcacgactggcagcaggtccccttctgctcccaccacttccacgagctgatcatgaaggacggccggaagctcgtggtcccgtgccgcccccaggacgagctgatcgggcgggcccgcatcagccagggcgccgggtggtccctgaaggagaccgcgtgcctcggcaaggcctacgcccagatgtgggccctgatgtacttccaccgccgggacctgcgcctcgcgagcaacgccatctgctccgccgtgcccgtgcactgggtccccaccagccggaccacgtggtccatccacgcccaccaccagtggatgaccaccgaggacatgctgaccgtgtggaaccgcgtgtggatcgaggacaacccgtggatggaggacaagacgcccgtcaccacctgggaggacgtgccctacctgggcaagcgggaggaccagtggtgcgggagcctcatcggcctggccagccgcgcgacctgggcccagaacatcctgacggccatccagcaggtccggtccctcatcgggaacgaggagttcctggactacatgcccagcatgaagcgcttccggaaggaggaggagtccgagggcgccatctggtga

SEQ ID NO: 10350 - RNA, 9873 nt, synthetic construct
  misc_feature 1..9873: note = derived and/or modified CDS sequence (opt1) from DENV-3__KC762685__SS-prME
  source 1..9873: mol_type = other RNA
accagcctgtgcctcatgatgatgctgcccgccaccctggccttccacctcacctcccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcggcaggtcgagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcaccaagttccagtgcctggagttcatcgagggcaaggtcgtgcagcacgagaacctcaagtacacggtgatcatcaccgtccacaccggggaccagcaccaggtgggcaacgagacccagggggtcacggccgagatcacgccccaggccagcaccgtggaggccatcctgcccgagtacggcaccctggggctcgagtgcagcccccgcaccggcctggacttcaacgagatgatcctgctcacgatgaagaacaaggcgtggatggtgcaccggcagtggttcttcgacctgccgctgccctggaccagcggcgccaccaccgagacgcccacctggaacaagaaggagctcctggtcaccttcaagaacgcccacgccaagaagcaggaggtggtggtcctggggtcccaggagggcgccatgcacaccgcgctcacgggggccaccgagatccagaccagcggcgggacctccatcttcgccggccacctgaagtgccgcctgaagatggacaagctcgagctgaagggcatgagctacgccatgtgcctgaacgccttcgtgctcaagaaggaggtgtccgagacgcagcacgggaccatcctgatcaaggtcgagtacaagggcgaggacgcgccctgcaagatcccgttcagcaccgaggacgggcagggcaaggcccacaacggccggctgatcaccgccaaccccgtggtgacgaagaaggaggagcccgtcaacatcgaggccgagcccccgttcggggagagcaacatcgtgatcggcatcggggacaaggcgctgaagatcaactggtacaagaagggctccagcatcgggaagatgttcgaggccaccgcccgcggcgcccggcgcatggccatcctcggcgacaccgcgtgggacttcgggtccgtgggcggggtcctgaacagcctgggcaagatggtgcaccagatcttcgggtccgcctacaccgccctcttcagcggcgtgtcctggatcatgaagatcggcatcggggtcctgctgacgtggatcggcctcaacagcaagaacacctccatgagcttctcctgcatcgtgatcgggatcatcaccctgtacctgggcgccgtggtccaggccgacatggggtgcgtgatcaactggaagggcaaggagctcaagtgcggcagcgggatcttcgtgaccaacgaggtccacacgtggaccgagcagtacaagttccaggcggactcccccaagcggctggccaccgccatcgccggcgcctgggagaacggggtgtgcggcatccgcagcaccacgcgcatggagaacctgctctggaagcagatcgcgaacgagctgaactacatcctgtgggagaacaacatcaagctcaccgtggtcgtgggggacatcatcggcgtgctggagcagggcaagcggaccctgacgccccagcccatggagctcaagtactcctggaagacgtgggggaaggccaagatcgtcaccgccgagacccagaacagctccttcatcatcgacggcccgaacacccccgagtgccccagcgcctcccgcgcgtggaacgtgtgggaggtggaggactacgggttcggcgtcttcacgaccaacatctggctgaagctgcgggagatgtacacccagctctgcgaccaccgcctgatgagcgccgccgtgaaggacgagcgggccgtgcacgccgacatgggctactggatcgagagccagaagaacgggtcctggaagctggagaaggcgagcctcatcgaggtcaagacctgcacctggcccaagtcccacacgctgtggagcaacggcgtgctggagtccgacatgatcatccccaagtccctcgccgggcccgtgtcccagcacaactaccgccccggctaccacacccagaccgccgggccgtggcacctgggcaagctggagctcgacttcaactactgcgagggcaccacggtcgtgatcaccgagaactgcgggacccggggccccagcctgcgcaccacgaccgtgtccgggaagctgatccacgagtggtgctgccggagctgcaccctgccgcccctccgctacatgggcgaggacgggtgctggtacggcatggagatccggccgatcaacgagaaggaggagaacatggtcaagtccctggtgagcgccggctccgggaaggtggacaacttcaccatgggcgtcctctgcctggccatcctgttcgaggaggtgatgcgcgggaagttcggcaagaagcacatgatcgcgggggtcctgttcacgttcgtcctgctgctcagcggccagatcacctggcgggacatggcccgcaccctgatcatgatcggctccaacgccagcgaccggatggggatgggcgtgacctacctggccctcatcgccacgttcaagatccagcccttcctggcgctggggttcttcctccgcaagctgacctcccgggagaacctgctcctgggcgtgggcctggccatggccaccaccctccagctgcccgaggacatcgagcagatggccaacgggatcgcgctgggcctcatggccctgaagctgatcacgcagttcgagacctaccagctctggaccgccctggtcagcctgatgtgcagcaacaccatcttcacgctcaccgtggcctggcgcaccgccaccctgatcctggcggggatctccctcctgcccgtctgccagagctccagcatgcggaagacggactggctgccggtgaccgtggccgccatgggcgtgccgcccctccccctgttcatcttctccctgaaggacaccctcaagcgccgcagctggccgctgaacgagggggtgatggccgtgggcctggtctccatcctcgccagctccctgctgcggaacgacgtgcccatggcgggccccctcgtggccgggggcctgctgatcgcctgctacgtcatcaccgggacgagcgccgacctcaccgtggagaaggccgcggacgtgatctgggaggaggaggccgagcagaccggcgtctcccacaacctgatgatcaccgtggacgacgacgggacgatgcgcatcaaggacgacgagaccgagaacatcctgaccgtgctcctgaagaccgccctgctcatcgtcagcggcatcttcccctactccatcccggccaccctgctggtgtggcacacgtggcagaagcagacccagcggagcggcgtgctctgggacgtccccagcccgcccgagacccagaaggccgagctggaggagggggtgtaccgcatcaagcagcagggcatcttcgggaagacccaggtgggcgtcggggtgcagaaggagggcgtgttccacacgatgtggcacgtcacccggggcgcggtgctgacccacaacgggaagcgcctcgagccgaactgggccagcgtgaagaaggacctgatctcctacggcgggggctggcggctgagcgcccagtggcagaagggggaggaggtccaggtgatcgccgtggagcccggcaagaaccccaagaacttccagaccatgcccggcatcttccagacgaccaccggggagatcggcgcgatcgccctggacttcaagccggggacctccggcagccccatcatcaaccgcgagggcaaggtcgtggggctctacggcaacggggtggtcacgaagaacggcgggtacgtgagcggcatcgcccagaccaacgccgagcccgacggcccgacccccgagctggaggaggagatgttcaagaagcggaacctgaccatcatggacctccaccccgggtccggcaagacgcgcaagtacctgcccgccatcgtgcgggaggcgatcaagcgccggctgcgcaccctcatcctggccccgacccgggtcgtggccgccgagatggaggaggccctgaaggggctccccatccgctaccagaccacggcgaccaagagcgcccacaccggcaaggagatcgtggacctgatgtgccacgccaccttcacgatgcggctgctctcccccgtccgcgtgcccaactacaacctgatcatcatggacgaggcccacttcaccgacccggccagcatcgcggcccgggggtacatctccacccgcgtgggcatgggcgaggccgccgcgatcttcatgaccgccacgccgcccgggaccgccgacgccttcccccagagcaacgccccgatccaggacgaggagcgggacatccccgagcgctcctggaacagcggcaacgagtggatcaccgacttcgcggggaagaccgtctggttcgtgccctccatcaaggccggcaacgacatcgccaactgcctgcgcaagaacgggaagaaggtgatccagctcagccggaagacgttcgacaccgagtaccagaagaccaagctgaacgactgggacttcgtcgtgaccacggacatctccgagatgggcgccaacttcaaggccgaccgcgtgatcgacccccggcgctgcctgaagccggtcatcctcaccgacggccccgagcgggtgatcctggcggggcccatgcccgtgaccgtcgccagcgccgcccagcgccggggccgcgtggggcggaacccgcagaaggagaacgaccagtacatcttcaccggccagcccctgaacaacgacgaggaccacgcccactggacggaggcgaagatgctcctggacaacatcaacacccccgaggggatcatccccgccctgttcgagccggagcgcgagaagtccgccgccatcgacggcgagtaccggctcaagggcgagagccgcaagaccttcgtcgagctgatgcggcgcggggacctgcccgtgtggctcgcgcacaaggtggcctccgagggcatcaagtacaccgaccggaagtggtgcttcgacggggagcgcaacaaccagatcctggaggagaacatggacgtcgagatctggaccaaggagggcgagaagaagaagctgcggccccgctggctcgacgcccggacgtacagcgaccccctggccctgaaggagttcaaggacttcgccgcgggccgcaagtccatcgccctcgacctggtgaccgagatcgggcgcgtgccgagccacctggcccaccggacccgcaacgccctcgacaacctggtcatgctgcacacctccgagcacggcgggcgggcctaccgccacgcggtggaggagctccccgagacgatggagaccctgctgctcctgggcctgatgatcctcctgaccgggggcgccatgctgttcctcatcagcggcaaggggatcggcaagaccagcatcgggctgatctgcgtggtcgcctccagcggcatgctgtggatggccgacgtgcccctccagtggatcgcctccgcgatcgtgctggagttcttcatgatggtcctgctcatcccggagcccgagaagcagcggacgccccaggacaaccagctggcctacgtggtgatcgggatcctgaccctcgccgccatcgtcgccgcgaacgagatgggcctgctggagaccaccaagcgcgacctcggcatgagcaaggagcccggggtggtgtccccgacgagctacctggacgtcgacctgcaccccgcctccgcctggaccctctacgccgtggcgaccaccgtgatcacgcccatgctgcggcacaccatcgagaacagcaccgccaacgtctccctggccgccatcgccaaccaggcggtggtgctcatgggcctggacaaggggtggcccatcagcaagatggacctgggcgtcccgctcctggccctggggtgctactcccaggtgaaccccctcaccctgacggccgccgtgctgctcctggtcacccactacgccatcatcggccccggcctgcaggcgaaggccacccgcgaggcccagaagcggaccgccgccgggatcatgaagaaccccacggtggacggcatcatgaccatcgacctcgacccggtgatctacgacagcaagttcgagaagcagctggggcaggtcatgctgctcgtgctgtgcgcggtgcagctgctcctgatgcgcacctcctgggccttctgcgaggccctgaccctcgccacgggccccatcaccaccctgtgggagggcagccccgggaagttctggaacaccacgatcgcggtctccatggccaacatcttccggggcagctacctggccggggccggcctcgccttctccatcatgaagtccgtggggaccggcaagcgcggcaccgggagccagggcgagaccctgggggagaagtggaagaagaagctgaaccagctcagccggaaggagttcgacctgtacaagaagtccggcatcacggaggtggaccgcaccgaggcgaaggaggggctgaagcggggcgagatcacccaccacgccgtctcccgcggcagcgccaagctccagtggttcgtggagcggaacatggtgatccccgaggggcgcgtcatcgacctgggctgcgggcggggcgggtggtcctactactgcgccggcctgaagaaggtgaccgaggtgcgcggctacaccaagggcgggccggggcacgaggagcccgtccccatgagcacgtacggctggaacatcgtgaagctcatgtccgggaaggacgtgttctacctgcccccggagaagtgcgacaccctgctgtgcgacatcggcgagagctcccccagccccaccgtcgaggagtcccggaccatccgcgtgctcaagatggtggagccctggctgaagaacaaccagttctgcatcaaggtcctgaacccgtacatgcccacggtgatcgagcacctcgagcgcctgcagcggaagcacggcgggatgctggtgcgcaaccccctcagccggaactccacccacgagatgtactggatcagcaacggcaccgggaacatcgtctccagcgtgaacatggtctcccgcctgctgctcaaccggttcaccatgacgcaccgccggcccaccatcgagaaggacgtggacctgggcgccggcacccgccacgtgaacgcggagccggagacccccaacatggacgtcatcggggagcggatccgccggatcaaggaggagcacagctccacgtggcactacgacgaggagaacccctacaagacctgggcctaccacggcagctacgaggtgaaggccaccgggtccgccagcagcatgatcaacggcgtggtcaagctgctcaccaagccgtgggacgtggtgcccacggtcacccagatggccatgaccgacaccacgcccttcgggcagcagcgcgtgttcaaggagaaggtggacacccggacgccccgcccgatgcccggcacccggaaggcgatggagatcaccgccgagtggctgtggcgcaccctgggccggaacaagcgcccccggctctgcacccgcgaggagttcaccaagaaggtccgcacgaacgccgccatgggggcggtgttcaccgaggagaaccagtgggactccgcccgggccgccgtggaggacgaggagttctggaagctggtcgaccgcgagcgggagctgcacaagctcggcaagtgcgggagctgcgtgtacaacatgatgggcaagcgcgagaagaagctgggggagttcggcaaggccaagggctcccgggcgatctggtacatgtggctgggggcccgctacctcgagttcgaggccctgggcttcctgaacgaggaccactggttcagccgggagaactccttcagcggggtggagggcgaggggctccacaagctgggctacatcctgcgcgacatctccaagatccccggcggggccatgtacgccgacgacaccgcgggctgggacacccggatcacggaggacgacctccacaacgaggagaagatcacccagcagatggagccggagcaccgccagctggccaacgccatcttcaagctgacctaccagaacaaggtcgtgaaggtgcagcggcccacccccaaggggacggtcatggacatcatcagccgcaaggaccagcggggctccggccaggtggggacctacggcctcaacaccttcaccaacatggaggtgcagctgatccgccagatggagggggagggcgtcctgagcaaggccgacctcgagaacccccacctcctggagaaggagatcacccagtggctcgagacgaagggggtggagcggctgaagcgcatggccatctccggcgacgactgcgtggtcaagccgatcgacgaccggttcgcggacgccctgctcgccctgaacgacatgggcaaggtgcgcaaggacatcccccagtggcagcccagcaaggggtggcacgactggcagcaggtccccttctgctcccaccacttccacgagctgatcatgaaggacggccggaagctcgtcgtgccgtgccgcccccaggacgagctgatcgggcgggcccgcatcagccagggcgccgggtggtccctgaaggagaccgcgtgcctcggcaaggcctacgcccagatgtgggccctgatgtacttccaccgccgggacctgcgcctcgcgagcaacgccatctgctccgccgtgcccgtccactgggtgcccaccagccggaccacgtggtccatccacgcccaccaccagtggatgaccaccgaggacatgctgaccgtgtggaaccgcgtctggatcgaggacaacccgtggatggaggacaagacgcccgtgaccacctgggaggacgtgccctacctgggcaagcgggaggaccagtggtgcgggagcctcatcggcctggccagccgcgcgacctgggcccagaacatcctgacggccatccagcaggtccggtccctcatcgggaacgaggagttcctggactacatgcccagcatgaagcgcttccggaaggaggaggagtccgagggcgccatctggtga

SEQ ID NO: 10351 - RNA, 9873 nt, synthetic construct
  misc_feature 1..9873: note = derived and/or modified CDS sequence (opt1) from DENV-3__KC762687__SS-prME
  source 1..9873: mol_type = other RNA
acctccctgtgcctcatgatgatgctgcccgccaccctggccttccacctcacctcccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtggagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctcttcgggaagggctccctggtgacctgcgccaagttccagtgcctggagttcatcgagggcaaggtcgtgcagcacgagaacctcaagtacaccgtgatcatcacggtccacaccggggaccagcaccaggtgggcaacgagacccagggggtcaccgccgagatcacgccccaggccagcaccgtggaggcgatcctgcccgagtacggcaccctggggctcgagtgcagcccccggaccggcctggacttcaacgagatgatcctgctcaccatgaagaacaaggcctggatggtgcaccggcagtggttcttcgacctgccgctgccctggacgagcggcgccaccaccgagacccccacgtggaacaagaaggagctcctggtcaccttcaagaacgcccacgccaagaagcaggaggtggtggtcctggggtcccaggagggcgcgatgcacaccgccctcaccggggccacggagatccagaccagcggcgggacctccatcttcgccggccacctgaagtgccgcctgaagatggacaagctcgagctgaagggcatgagctacgccatgtgcctgaacgcgttcgtgctcaagaaggaggtgtccgagacccagcacgggacgatcctgatcaaggtcgagtacaagggcgaggacgccccctgcaagatcccgttcagcaccgaggacgggcagggcaaggcccacaacggccggctgatcaccgccaaccccgtggtggtcaagaaggaggagcccgtgaacatcgaggcggagcccccgttcggggagagcaacatcgtgatcggcatcggggacaaggccctgaagatcaactggtacaagaagggctccagcatcgggaagatgttcgaggccaccgcccgcggcgcccggcgcatggcgatcctcggcgacacggcctgggacttcgggtccgtcggcggggtgctgaacagcctgggcaagatggtgcaccagatcttcgggtccgcctacaccgccctcttcagcggcgtctcctggatcatgaagatcggcatcggggtgctgctgacctggatcggcctcaacagcaagaacacctccatgagcttctcctgcatcgtgatcgggatcatcacgctgtacctgggcgccgtcgtgcaggcggacatggggtgcgtgatcaactggaagggcaaggagctcaagtgcggcagcgggatcttcgtcaccaacgaggtgcacacctggaccgagcagtacaagttccaggccgactcccccaagcggctggccacggccatcgccggcgcgtgggagaacggggtgtgcggcatccgcagcaccacccgcatggagaacctgctctggaagcagatcgccaacgagctgaactacatcctgtgggagaacaacatcaagctcaccgtcgtggtgggggacatcatcggcgtcctggagcagggcaagcggacgctgacgccccagcccatggagctcaagtactcctggaagacctgggggaaggccaagatcgtgaccgccgagacgcagaacagctccttcatcatcgacggcccgaacacccccgagtgccccagcgcgtcccgcgcctggaacgtgtgggaggtcgaggactacgggttcggcgtgttcaccaccaacatctggctgaagctgcgggagatgtacacgcagctctgcgaccaccgcctgatgagcgccgccgtgaaggacgagcgggccgtccacgcggacatgggctactggatcgagagccagaagaacgggtcctggaagctggagaaggccagcctcatcgaggtgaagacctgcacctggcccaagtcccacaccctgtggagcaacggcgtgctggagtccgacatgatcatccccaagtccctcgccgggcccgtctcccagcacaactaccgccccggctaccacacccagacggccgggccgtggcacctgggcaagctggagctcgacttcaactactgcgagggcaccaccgtggtgatcaccgagaactgcgggacgcggggccccagcctgcgcaccaccaccgtctccgggaagctgatccacgagtggtgctgccggagctgcacgctgccgcccctccgctacatgggcgaggacgggtgctggtacggcatggagatccggccgatcaacgagaaggaggagaacatggtgaagtccctggtgagcgccggctccgggaaggtcgacaacttcaccatgggcgtgctctgcctggcgatcctgttcgaggaggtgatgcgcgggaagttcggcaagaagcacatgatcgccggggtcctcttcaccttcgtgctgctgctcagcggccagatcacctggcgggacatggcccgcacgctgatcatgatcggctccaacgccagcgaccggatggggatgggcgtgacctacctggccctcatcgcgaccttcaagatccagcccttcctggccctggggttcttcctccgcaagctgacctcccgggagaacctgctcctgggcgtcggcctggccatggccacgaccctccagctgcccgaggacatcgagcagatggcgaacgggatcgccctgggcctcatggccctgaagctgatcacccagttcgagacctaccagctctggacggccctggtgagcctgatgtgcagcaacaccatcttcaccctcaccgtcgcctggcgcacggcgaccctgatcctggccgggatctccctcttccccgtgtgccagagctccagcatgcggaagaccgactggctgccggtgaccgtcgccgccatgggcgtgccgcccctgcccctcttcatcttctccctgaaggacacgctgaagcgccgcagctggccgctcaacgagggggtgatggccgtcggcctggtgtccatcctggcgagctccctcctgcggaacgacgtgcccatggccggccccctggtcgccgggggcctcctgatcgcctgctacgtgatcaccgggaccagcgccgacctgaccgtggagaaggcggccgacgtcatctgggaggaggaggccgagcagacgggcgtgtcccacaacctcatgatcaccgtggacgacgacgggaccatgcgcatcaaggacgacgagaccgagaacatcctgacggtcctgctcaagaccgccctgctgatcgtgagcggcatcttcccctactccatcccggccaccctcctggtgtggcacacctggcagaagcagacccagcggagcggcgtcctgtgggacgtgcccagcccgcccgagacgcagaaggcggagctcgaggagggggtgtaccgcatcaagcagcagggcatcttcgggaagacccaggtcggcgtgggggtgcagaaggagggcgtcttccacaccatgtggcacgtgacccggggcgccgtgctgacgcacaacgggaagcgcctggagccgaactgggccagcgtcaagaaggacctcatctcctacggcgggggctggcggctgagcgcccagtggcagaagggggaggaggtccaggtgatcgcggtcgagcccggcaagaaccccaagaacttccagaccatgcccggcaccttccagaccacgaccggggagatcggcgccatcgccctggacttcaagccggggacctccggcagccccatcatcaaccgcgagggcaaggtggtggggctgtacggcaacggggtcgtgaccaagaacggcgggtacgtgagcggcatcgcccagacgaacgccgagcccgacggcccgacccccgagctcgaggaggagatgttcaagaagcggaacctgaccatcatggacctgcaccccgggtccggcaagacccgcaagtacctccccgcgatcgtccgggaggccatcaagcgccggctgcgcacgctgatcctcgccccgacccgggtggtggccgccgagatggaggaggcgctgaaggggctgcccatccgctaccagaccaccgccaccaagagcgtccacaccggcaaggagatcgtggacctcatgtgccacgccaccttcaccatgcggctgctgtcccccgtgcgcgtccccaactacaacctcatcatcatggacgaggcccacttcacggacccggccagcatcgcggcccgggggtacatctccacccgcgtgggcatgggcgaggccgccgcgatcttcatgaccgccacgccgcccgggacggccgacgccttcccccagagcaacgccccgatccaggacgaggagcgggacatccccgagcgctcctggaacagcggcaacgagtggatcaccgacttcgcggggaagaccgtgtggttcgtcccctccatcaaggccggcaacgacatcgccaactgcctgcgcaagaacgggaagaaggtgatccagctgagccggaagaccttcgacacggagtaccagaagaccaagctcaacgactgggacttcgtggtcaccaccgacatctccgagatgggcgccaacttcaaggccgaccgcgtgatcgacccccggcgctgcctgaagccggtgatcctgacggacggccccgagcgggtcatcctcgcggggcccatgcccgtgaccgtcgccagcgccgcccagcgccggggccgcgtggggcggaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgcgagaagtccgccgccatcgacggcgagtaccggctgaagggcgagagccgcaagaccttcgtggagctcatgcggcgcggggacctgcccgtctggctggcgcacaaggtggcctccgagggcatcaagtacaccgaccggaagtggtgcttcgacggggagcgcaacaaccagatcctcgaggagaacatggacgtggagatctggaccaaggagggcgagaagaagaagctgcggccccgctggctggacgcccggacctacagcgaccccctcgccctgaaggagttcaaggacttcgccgcgggccgcaagtccatcgccctggacctcgtcacggagatcgggcgcgtgccgagccacctggcccacaagacccggtccgccctggacaacctcgtgatgctgcacaccagcgagcacggcgggcgcgcctaccggcacgcggtcgaggagctgcccgagaccatggagacgctcctgctgctcggcctgatgatcctgctcaccgggggcgccatgctgttcctgatcagcggcaaggggatcggcaagacctccatcgggctcatctgcgtggtggccagctccggcatgctgtggatggccgacgtccccctgcagtggatcgccagcgcgatcgtgctcgagttcttcatgatggtgctgctgatcccggagcccgagaagcagcgcacgccccaggacaaccagctcgcctacgtcgtgatcgggatcctgacgctggccgccatcgtggccgcgaacgagatgggcctcctggagaccaccaagcgggacctgggcatgtccaaggagcccggggtcgtgagcccgacctcctacctcgacgtggacctgcaccccgccagcgcctggacgctgtacgccgtcgcgaccaccgtgatcacccccatgctccgccacacgatcgagaactccaccgccaacgtgagcctggccgccatcgccaaccaggcggtcgtgctgatgggcctcgacaaggggtggcccatctccaagatggacctgggcgtgccgctgctcgccctggggtgctacagccaggtcaaccccctgaccctcaccgccgccgtgctgctgctcgtgacgcactacgccatcatcggccccggcctgcaggcgaaggccacccgggaggcccagaagcgcaccgccgccgggatcatgaagaaccccaccgtcgacggcatcatgacgatcgacctggacccggtgatctacgactccaagttcgagaagcagctcggccaggtgatgctgctggtcctctgcgcggtgcagctgctgctcatgcggaccagctgggccttctgcgaggccctgaccctggccaccggccccatcacgaccctctgggagggctcccccgggaagttctggaacaccaccatcgcggtgagcatggccaacatcttccgcggctcctacctggccggggccggcctggccttcagcatcatgaagtccgtcgggacgggcaagcggggcaccgggagccagggcgagaccctcggggagaagtggaagaagaagctgaaccagctgagccgcaaggagttcgacctctacaagaagtccggcatcaccgaggtggaccggacggaggcgaaggaggggctgaagcgcggcgagatcacccaccacgccgtgagccggggctccgccaagctgcagtggttcgtcgagcgcaacatggtgatccccgaggggcgggtgatcgacctcggctgcgggcgcggcgggtggagctactactgcgccggcctgaagaaggtcaccgaggtgcggggctacaccaagggcgggccggggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccgcaccatccgggtcctgaagatggtggagccctggctcaagaacaaccagttctgcatcaaggtgctgaacccctacatgcccaccgtcatcgagcacctggagcgcctccagcgcaagcacggcgggatgctggtgcggaaccccctgtcccgcaacagcacgcacgagatgtactggatctccaacggcaccgggaacatcgtcagctccgtgaacatggtgagccggctcctgctgaaccgcttcaccatgacccaccggcgccccacgatcgagaaggacgtcgacctcggcgccggcacccggcacgtgaacgcggagccggagacccccaacatggacgtgatcggggagcgcatccggcgcatcaaggaggagcactccagcacctggcactacgacgaggagaacccctacaagacgtgggcctaccacggctcctacgaggtcaaggccaccgggagcgccagctccatgatcaacggcgtggtgaagctgctgaccaagccgtgggacgtcgtgcccaccgtgacgcagatggccatgaccgacaccacccccttcgggcagcagcgggtcttcaaggagaaggtggacacgcgcacgccccggccgatgcccggcacccgcaaggcgatggagatcaccgccgagtggctctggcggaccctgggccgcaacaagcggccccgcctgtgcacccgggaggagttcaccaagaaggtgcgcaccaacgccgccatgggggcggtcttcacggaggagaaccagtgggacagcgccaaggccgccgtggaggacgaggagttctggaagctcgtggaccgcgagcgggagctgcacaagctgggcaagtgcgggtcctgcgtctacaacatgatgggcaagcgcgagaagaagctcggggagttcggcaaggccaagggcagccgggcgatctggtacatgtggctgggggcccgctacctggagttcgaggccctcggcttcctgaacgaggaccactggttctcccgggagaacagcttctccggggtggagggcgaggggctgcacaagctcggctacatcctgcgcgacatcagcaagatccccggcggggccatgtacgccgacgacaccgcgggctgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaaggggaccgtgatggacatcatctcccgcaaggaccagcggggcagcggccaggtcgggacgtacggcctgaacaccttcaccaacatggaggtgcagctcatccgccagatggagggggagggcgtgctgtccaaggccgacctggagaacccccacctcctggagaaggagatcacccagtggctggagaccaagggggtcgagcggctcaagcgcatggccatcagcggcgacgactgcgtggtgaagccgatcgacgaccggttcgcggacgccctgctggccctcaacgacatgggcaaggtccgcaaggacatcccccagtggcagccctccaaggggtggcacgactggcagcaggtccccttctgcagccaccacttccacgagctgatcatgaaggacggccggaagctggtggtcccgtgccgcccccaggacgagctcatcgggcgggcccgcatctcccagggcgccgggtggagcctgcgggagacggcgtgcctgggcaaggcctacgcccagatgtgggccctcatgtacttccaccgccgcgacctgcggctggcgtccaacgccatctgcagcgccgtgcccgtgcactgggtccccacctcccgcaccacctggagcatccacgcccaccaccagtggatgacgaccgaggacatgctcaccgtgtggaaccgggtgtggatcgaggacaacccgtggatggaggacaagacccccgtcacgacctgggaggacgtgccctacctgggcaagcgcgaggaccagtggtgcgggagcctgatcggcctcgcctcccgggcgacctgggcccagaacatcctgaccgccatccagcaggtccgcagcctgatcgggaacgaggagttcctcgactacatgccctccatgaagcggttccgcaaggaggaggagagcgagggcgccatctggtga

SEQ ID NO: 10352 - RNA, 9873 nt, synthetic construct
  misc_feature 1..9873: note = derived and/or modified CDS sequence (opt1) from DENV-3__KC762688__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcggcaggtcgagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagttcatcgagggcaaggtcgtgcagcacgagaacctcaagtacaccgtgatcatcacggtccacaccggggaccagcaccaggtgggcaacgagacccagggggtcaccgccgagatcacgccccaggccagcaccgtggaggcgatcctgcccgagtacggcaccctggggctcgagtgcagcccccgcaccggcctggacttcaacgagatgatcctgctcaccatgaagaacaaggcctggatggtgcaccggcagtggttcttcgacctgccgctgccctggacgagcggcgccaccaccgagacccccacgtggaacaagaaggagctcctggtcaccttcaagaacgcccacgccaagaagcaggaggtggtggtcctggggtcccaggagggcgcgatgcacaccgccctcaccggggccacggagatccagaccagcggcgggacctccatcttcgccggccacctgaagtgccgcctgaagatggacaagctcgagctgaagggcatgagctacgccatgtgcctgaacgcgttcgtgctcaagaaggaggtgtccgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagagcaacatcgtgatcggcatcggggacaaggccctgaagatcaactggtacaagaagggctccagcatcgggaagatgttcgaggccacggcccgcggcgcccggcgcatggcgatcctcggcgacaccgcctgggacttcgggtccgtgggcggggtcctgaacagcctgggcaagatggtgcaccagatcttcgggtccgcctacaccgccctcttcagcggcgtgtcctggatcatgaagatcggcatcggggtcctgctgacctggatcggcctcaacagcaagaacacgtccatgagcttctcctgcatcgtgatcgggatcatcaccctgtacctgggcgccgtggtccaggcggacatggggtgcgtgatcaactggaagggcaaggagctcaagtgcggcagcgggatcttcgtgaccaacgaggtccacacctggacggagcagtacaagttccaggccgactcccccaagcggctggccaccgccatcgccggcgcgtgggagaacggggtgtgcggcatccgcagcaccacccgcatggagaacctgctctggaagcagatcgccaacgagctgaactacatcctgtgggagaacaacatcaagctcacggtggtcgtgggggacatcatcggcgtgctggagcagggcaagcggaccctgacgccccagcccatggagctcaagtactcctggaagacctgggggaaggccaagatcgtcacggccgagacccagaacagctccttcatcatcgacggcccgaacacccccgagtgccccagcgcgtcccgcgcctggaacgtgtgggaggtggaggactacgggttcggcgtcttcaccacgaacatctggctgaagctgcgggagatgtacacccagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacctgcacctggcccaagtcccacaccctgtggagcaacggcgtgctggagtccgacatgatcatccccaagtccctcgccgggcccgtgtcccagcacaactaccgccccggctaccacacgcagaccgccgggccgtggcacctgggcaagctggagctcgacttcaactactgcgagggcaccaccgtcgtgatcacggagaactgcgggacccggggccccagcctgcgcaccaccacggtgtccgggaagctgatccacgagtggtgctgccggagctgcaccctgccgcccctccgctacatgggcgaggacgggtgctggtacggcatggagatccggccgatcaacgagaaggaggagaacatggtcaagtccctggtgagcgccggctccgggaaggtggacaacttcaccatgggcgtcctctgcctggcgatcctgttcgaggaggtgatgcgcgggaagttcggcaagaagcacatgatcgccggggtcctgttcaccttcgtcctgctgctcagcggccagatcacgtggcgggacatggcccgcaccctgatcatgatcggctccaacgccagcgaccggatggggatgggcgtgacctacctggccctcatcgcgaccttcaagatccagcccttcctggccctggggttcttcctccgcaagctgacgtcccgggagaacctgctcctgggcgtgggcctggccatggccaccaccctccagctgcccgaggacatcgagcagatggcgaacgggatcgccctgggcctcatggccctgaagctgatcacccagttcgagacgtaccagctctggaccgccctggtcagcctgatgtgcagcaacaccctcttcaccctgacggtggcctggcgcaccgcgaccctgatcctcgccgggatctccctgctgcccgtctgccagagctccagcatgcggaagaccgactggctcccggtgacggtggccgccatgggcgtgccgcccctgcccctgttcatcttctccctcaaggacaccctgaagcgccgcagctggccgctgaacgagggggtgatggccgtgggcctcgtctccatcctggcgagctccctgctccggaacgacgtgcccatggccggccccctggtggccgggggcctgctcatcgcctgctacgtcatcaccgggaccagcgccgacctgacggtggagaaggcggccgacgtgatctgggaggaggaggccgagcagaccggcgtctcccacaacctgatgatcaccgtggacgacgacgggaccatgcgcatcaaggacgacgagacggagaacatcctcaccgtgctgctgaagaccgccctcctgatcgtcagcggcatcttcccctactccatcccggccaccctgctcgtgtggcacacctggcagaagcagacgcagcggagcggcgtgctgtgggacgtccccagcccgcccgagacccagaaggcggagctggaggagggggtgtaccgcatcaagcagcagggcatcttcgggaagacccaggtgggcgtcggggtgcagaaggagggcgtgttccacaccatgtggcacgtcacgcggggcgccgtgctcacccacaacgggaagcgcctggagccgaactgggccagcgtgaagaaggacctgatctcctacggcgggggctggcggctgagcgcccagtggcagaagggggaggaggtccaggtgatcgcggtggagcccggcaagaaccccaagaacttccagaccatgcccggcatcttccagaccacgaccggggagatcggcgccatcgccctcgacttcaagccggggacctccggcagccccatcatcaaccgcgagggcaaggtcgtggggctgtacggcaacggggtggtcaccaagaacggcgggtacgtgagcggcatcgcccagacgaacgccgagcccgacggcccgacccccgagctggaggaggagatgttcaagaagcggaacctcaccatcatggacctgcaccccgggtccggcaagacccgcaagtacctgcccgcgatcgtgcgggaggccatcaagcgccggctccgcacgctgatcctggccccgacccgggtcgtggccgccgagatggaggaggcgctcaaggggctgcccatccgctaccagaccaccgccaccaagagcgcccacaccggcaaggagatcgtggacctgatgtgccacgccaccttcaccatgcggctcctgtcccccgtccgcgtgcccaactacaacctgatcatcatggacgaggcccacttcacggacccggcgagcatcgccgcccgggggtacatctccacccgcgtgggcatgggcgaggccgcggccatcttcatgaccgccacgccgcccgggacggccgacgccttcccccagagcaacgcgccgatccaggacgaggagcgggacatccccgagcgctcctggaacagcggcaacgagtggatcaccgacttcgccgggaagaccgtctggttcgtgccctccatcaaggccggcaacgacatcgccaactgcctccgcaagaacgggaagaaggtgatccagctgagccggaagaccttcgacacggagtaccagaagaccaagctgaacgactgggacttcgtcgtgaccaccgacatctccgagatgggcgccaacttcaaggcggaccgcgtgatcgacccccggcgctgcctcaagccggtcatcctgacggacggccccgagcgggtgatcctggccgggcccatgcccgtgaccgtcgccagcgccgcccagcgccggggccgcgtggggcggaacccgcagaaggagaacgaccagtacatcttcaccggccagcccctcaacaacgacgaggaccacgcgcactggaccgaggccaagatgctgctggacaacatcaacacgcccgaggggatcatccccgccctcttcgagccggagcgcgagaagtccgccgcgatcgacggcgagtaccggctgaagggcgagagccgcaagaccttcgtcgagctgatgcggcgcggggacctccccgtgtggctggcccacaaggtggcctccgagggcatcaagtacaccgaccggaagtggtgcttcgacggggagcgcaacaaccagatcctggaggagaacatggacgtcgagatctggaccaaggagggcgagaagaagaagctccggccccgctggctggacgcccggacctacagcgaccccctggccctcaaggagttcaaggacttcgcggccggccgcaagtccatcgccctggacctggtgacggagatcgggcgcgtgccgagccacctcgcccaccggacccgcaacgccctggacaacctggtcatgctccacacctccgagcacggcgggcgggcgtaccgccacgccgtggaggagttccccgagaccatggagacgctgctgctcctgggcctgatgatcctcctgaccgggggcgccatgctgttcctcatcagcggcaaggggatcggcaagaccagcatcgggctgatctgcgtggtcgcctccagcggcatgctgtggatggccgacgtgcccctccagtggatcgcgtccgccatcgtgctggagttcttcatgatggtcctgctcatcccggagcccgagaagcagcggacgccccaggacaaccagctggcctacgtggtgatcgggatcctgacgctcgccgccatcgtcgcggccaacgagatgggcctgctggagaccaccaagcgcgacctcggcatgagcaaggagcccggggtggtgtccccgaccagctacctggacgtcgacctgcaccccgcctccgcctggacgctctacgcggtggccaccaccgtgatcacccccatgctgcggcacacgatcgagaacagcaccgccaacgtctccctggccgccatcgcgaaccaggccgtggtgctcatgggcctggacaaggggtggcccatcagcaagatggacctgggcgtcccgctcctggccctggggtgctactcccaggtgaaccccctcaccctgaccgccgccgtgctgctcctggtcacgcactacgcgatcatcggccccggcctgcaggccaaggccacccgcgaggcccagaagcggaccgccgcggggatcatgaagaaccccaccgtggacggcatcatgacgatcgacctcgacccggtgatctacgacagcaagttcgagaagcagctggggcaggtcatgctgctcgtgctgtgcgccgtgcagctgctcctgatgcgcacctcctgggccttctgcgaggccctgaccctcgcgaccggccccatcacgaccctgtgggagggcagccccgggaagttctggaacaccaccatcgccgtctccatggccaacatcttccggggcagctacctggccggggccggcctcgcgttctccatcatgaagtccgtggggacgggcaagcgcggcaccgggtcccagggcgagaccctgggggagaagtggaagaagaagctgaaccagctcagccggaaggagttcgacctgtacaagaagtccggcatcaccgaggtggaccgcacggaggccaaggaggggctgaagaagggcgagatcacccaccacgccgtctcccggggcagcgccaagctccagtggttcgtggagcgcaacatggtgatccccgaggggcgggtcatcgacctgggctgcgggcgcggcgggtggtcctactactgcgccggcctgaagaaggtgaccgaggtgcggggctacaccaagggcgggccggggcacgaggagcccgtccccatgagcacctacggctggaacatcgtgaagctcatgtccgggaaggacgtgttctacctgcccccggagaagtgcgacacgctgctgtgcgacatcggcgagagctcccccagccccaccgtcgaggagtcccgcaccatccgggtgctcaagatggtggagccctggctgaagaacaaccagttctgcatcaaggtcctgaacccgtacatgcccaccgtgatcgagcacctcgagcgcctgcagcgcaagcacggcgggatgctggtgcggaaccccctcagccgcaactccacgcacgagatgtactggatcagcaacggcaccgggaacatcgtctccagcgtgaacatggtctcccggctgctgctcaaccgcttcaccatgacccaccggcgccccacgatcgagaaggacgtggacctgggcgcgggcacccggcacgtgaacgccgagccggagacccccaacatggacgtcatcggggagcgcatccggcgcatcaaggaggagcacagctccacctggcactacgacgaggagaacccctacaagacgtgggcctaccacggcagctacgaggtgaaggccaccgggtccgccagcagcatgatcaacggcgtggtcaagctgctcaccaagccgtgggacgtggtgcccaccgtcacgcagatggcgatgaccgacaccacccccttcgggcagcagcgggtgttcaaggagaaggtggacacgcgcacgccccggccgatgcccggcacccgcaaggccatggagatcaccgccgagtggctgtggcggaccctgggccgcaacaagcggccccgcctctgcacccgggaggagttcaccaagaaggtccgcaccaacgccgcgatgggggccgtgttcacggaggagaaccagtgggactccgcccgcgccgccgtggaggacgaggagttctggaagctggtcgaccgggagcgcgagctgcacaagctcggcaagtgcgggagctgcgtgtacaacatgatgggcaagcgggagaagaagctgggggagttcggcaaggcgaagggctcccgcgccatctggtacatgtggctgggggcccggtacctcgagttcgaggccctgggcttcctgaacgaggaccactggttcagccgcgagaactccttcagcggggtggagggcgaggggctccacaagctgggctacatcctgcgggacatctccaagatccccggcggggccatgtacgcggacgacaccgccggctgggacacccgcatcaccgaggacgacctccacaacgaggagaagatcacgcagcagatggacccggagcaccggcagctggccaacgccatcttcaagctgacctaccagaacaaggtcgtgaaggtgcagcgccccacccccaaggggaccgtcatggacatcatcagccggaaggaccagcgcggctccggccaggtggggacgtacggcctcaacaccttcaccaacatggaggtgcagctgatccggcagatggagggggagggcgtcctgagcaaggccgacctcgagaacccccacctcctggagaaggagatcacccagtggctcgagaccaagggggtggagcgcctgaagcggatggcgatctccggcgacgactgcgtggtcaagccgatcgacgaccgcttcgccgacgccctgctcgccctgaacgacatgggcaaggtgcggaaggacatcccccagtggcagcccagcaaggggtggcacgactggcagcaggtccccttctgctcccaccacttccacgagctgatcatgaaggacggccgcaagctcgtcgtgccgtgccggccccaggacgagctgatcgggcgcgcccggatcagccagggcgcggggtggtccctgaaggagacggcctgcctcggcaaggcctacgcccagatgtgggcgctgatgtacttccaccgccgcgacctgcggctcgccagcaacgccatctgctccgccgtgcccgtccactgggtgcccaccagccgcaccacctggtccatccacgcccaccaccagtggatgacgaccgaggacatgctgaccgtgtggaaccgggtctggatcgaggacaacccgtggatcgaggacaagacccccgtgacgacctgggaggacgtgccctacctgggcaagcgcgaggaccagtggtgcgggagcctcatcggcctggcgagccgggccacctgggcccagaacatcctgaccgccatccagcaggtccgctccctcatcgggaacgaggagttcctggactacatgcccagcatgaagcggttccgcaaggaggaggagtccgagggcgccatctggtga

SEQ ID NO: 10353 - RNA, 9873 nt, synthetic construct
  misc_feature 1..9873: note = derived and/or modified CDS sequence (opt1) from DENV-3__KC762689__SS-prME
  source 1..9873: mol_type = other RNA
accagcctgtgcctcatgatgatgatccccgccaccctggccttccacctgaccagccgcgacggcgagccccggatgatcgtggggaagaacgagcgcggcaagagcctcctgttcaagaccgcgagcgggatcaacatgtgcaccctgatcgccatggacctcggcgagatgtgcgacgacaccgtgacctacaagtgccccctgatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcgcgcagacctggatgagcgccgagggcgcctggcggcaggtcgagaaggtcgagacgtgggccttccgccaccccgggttcaccatcctggccctcttcctggcccactacatcggcacctccctgacccagaaggtggtgatcttcatcctcctgatgctggtcacgcccagcatgaccatgcggtgcgtgggggtgggcaaccgcgacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcggaagctctgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctgttcgggaagggctccctcgtgacctgcgccaagttccagtgcctggagttcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctccccgagtacggcaccctggggctggagtgcagcccccgcaccggcctcgacttcaacgagatgatcctgctgaccatgaagaacaaggcctggatggtgcaccggcagtggttcttcgacctcccgctgccctggacgagcggcgccaccaccgagacccccacgtggaacaagaaggagctgctcgtcaccttcaagaacgcccacgccaagaagcaggaggtggtggtcctggggtcccaggagggcgcgatgcacaccgccctgaccggggccacggagatccagaccagcggcgggacctccatcttcgccggccacctcaagtgccgcctgaagatggacaagctggagctcaagggcatgagctacgccatgtgcctgaacgcgttcgtgctgaagaaggaggtgtccgagacccagcacgggacgatcctcatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagagcaacatcgtgatcggcatcggggacaaggccctgaagatcaactggtacaagaagggctccagcatcgggaagatgttcgaggccacggcccgcggcgcccggcgcatggcgatcctgggcgacaccgcctgggacttcgggtccgtgggcggggtcctcaacagcctgggcaagatggtgcaccagatcttcgggtccgcctacaccgccctgttcagcggcgtgtcctggatcatgaagatcggcatcggggtcctcctgacctggatcggcctgaacagcaagaacacgtccatgagcttctcctgcatcgtgatcgggatcatcaccctctacctgggcgccgtggtccaggcggacatggggtgcgtgatcaactggaagggcaaggagctgaagtgcggcagcgggatcttcgtgaccaacgaggtccacacctggacggagcagtacaagttccaggccgactcccccaagcggctcgccaccgccatcgccggcgcgtgggagaacggggtgtgcggcatccgcagcaccacccgcatggagaacctgctgtggaagcagatcgccaacgagctcaactacatcctgtgggagaacaacatcaagctgacggtggtcgtgggggacatcatcggcgtgctcgagcagggcaagcggaccctgacgccccagcccatggagctgaagtactcctggaagacctgggggaaggccaagatcgtcacggccgagacccagaacagctccttcatcatcgacggcccgaacacccccgagtgccccagcgcgtcccgcgcctggaacgtgtgggaggtggaggactacgggttcggcgtcttcaccacgaacatctggctcaagctgcgggagatgtacacccagctgtgcgaccaccgcctcatgagcgccgccgtgaaggacgagcgggccgtgcacgcggacatgggctactggatcgagagccagaagaacgggtcctggaagctggagaaggccagcctgatcgaggtcaagacctgcacctggcccaagtcccacaccctctggagcaacggcgtgctggagtccgacatgatcatccccaagtccctggccgggcccgtgtcccagcacaactaccgccccggctaccacacgcagaccgccgggccgtggcacctcggcaagctggagctggacttcaactactgcgagggcaccaccgtcgtgatcacggagagctgcgggacccggggcccctccctccgcaccaccacggtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggtggacaacttcaccatgggcgtcctgtgcctcgcgatcctgttcgaggaggtgatgcgcgggaagttcggcaagaagcacatgatcgccggggtgctgttcaccttcgtcctcctgctgtccggccagatcacgtggcgggacatggcccgcaccctcatcatgatcggcagcaacgcctccgaccggatggggatgggcgtgacctacctggccctgatcgcgaccttcaagatccagcccttcctcgccctggggttcttcctgcgcaagctcacgagccgggagaacctgctgctcggcgtgggcctggccatggccaccaccctgcagctccccgaggacatcgagcagatggcgaacgggatcgccctgggcctgatggccctcaagctgatcacccagttcgagacgtaccagctgtggaccgccctcgtcagcctgatgtgctccaacaccatcttcaccctgacggtggcctggcgcaccgcgaccctcatcctggccgggatcagcctgctccccgtctgccagtccagctccatgcggaagaccgactggctgccggtgacggtggccgccatgggcgtgccgcccctgcccctcttcatcttcagcctgaaggacaccctgaagcgccgctcctggccgctcaacgagggggtgatggccgtgggcctggtcagcatcctggcgtccagcctcctgcggaacgacgtgcccatggccggccccctggtggccgggggcctcctgatcgcctgctacgtcatcaccgggacctccgccgacctgacggtggagaaggcggccgacgtgatctgggaggaggaggccgagcagaccggcgtcagccacaacctcatgatcaccgtggacgacgacgggaccatgcgcatcaaggacgacgagacggagaacatcctgaccgtgctgctcaagaccgccctgctgatcgtctccggcatcttcccctacagcatcccggccaccctcctggtgtggcacacctggcagaagcagacgcagcggtccggcgtgctgtgggacgtcccctccccgcccgagacccagaaggcggagctcgaggagggggtgtaccgcatcaagcagcagggcatcttcgggaagacccaggtgggcgtcggggtgcagaaggagggcgtgttccacaccatgtggcacgtcacgcggggcgccgtgctgacccacaacgggaagcgcctggagccgaactgggcctccgtgaagaaggacctcatcagctacggcgggggctggcggctgtccgcccagtggcagaagggggaggaggtccaggtggtggcggtcgagcccggcaagaaccccaagaacttccagaccatgcccggcatcttccagaccacgaccggggagatcggcgccatcgccctggacttcaagccggggaccagcggcagccccatcatcaaccgcgagggcaaggtggtggggctgtacggcaacggggtcgtgaccaagaacggcgggtacgtgtccggcatcgcccagacgaacgccgagcccgacggcccgacccccgacctcgaggaggagatgttcaagaagcggaacctgaccatcatggacctgcaccccgggagcggcaagacccgcaagtacctccccgcgatcgtccgggaggccatcaagcgccggctgcgcacgctgatcctcgccccgacccgggtggtggccgccgagatggaggaggcgctgaaggggctgcccatccgctaccagaccaccgccacgaagtccgtccacaccggcaaggagatcgtggacctcatgtgccacgccaccttcaccatgcggctgctgagccccgtgcgcgtccccaactacaacctcatcatcatggacgaggcccacttcacggacccggcctccatcgcggcccgggggtacatcagcacccgcgtgggcatgggcgaggccgccgcgatcttcatgaccgccacgccgcccgggacggccgacgccttcccccagtccaacgccccgatccaggacgaggagcgggacatccccgagcgcagctggaactccggcaacgagtggatcaccgacttcgcggggaagaccgtgtggttcgtccccagcatcaaggccggcaacgacatcgccaactgcctgcgcaagaacgggaagaaggtgatccagctgtcccggaagaccttcgacacggagtaccagaagaccaagctcaacgactgggacttcgtggtcaccaccgacatcagcgagatgggcgccaacttcaaggccgaccgcgtgatcgacccccggcgctgcctgaagccggtgatcctgacggacggccccgagcgggtcatcctcgcggggcccatgcccgtgaccgtcgcctccgccgcccagcgccggggccgcgtggggcggaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgcgagaagtccgccgccatcgacggcgagtaccggctgaagggcgagtcccgcaagaccttcgtggagctcatgcggcgcggggacctgcccgtctggctggcgcacaaggtggccagcgagggcatcaagtacaccgaccggaagtggtgcttcgacggggagcgcaacaaccagatcctcgaggagaacatggacgtggagatctggaccaaggagggcgagaagaagaagctgcggccccgctggctggacgcccggacctactccgaccccctcgccctgaaggagttcaaggacttcgccgcgggccgcaagagcatcgccctggacctcgtcacggagatcgggcgcgtgccgtcccacctggcctaccggacccgcaacgccctggacaacctcgtgatgctgcacaccagcgagcacggcgggcgggcctaccgccacgcggtcgaggagctgcccgagaccatggagacgctcctgctgctcggcctgatgatcctgctcaccgggggcgccatgctgttcctgatcagcggcaaggggatcggcaagacctccatcgggctcatctgcgtggtggccagctccggcatgctgtggatggccgacgtccccctgcagtggatcgccagcgcgatcgtgctcgagttcttcatgatggtgctgctgatcccggagcccgagaagcagcggacgccccaggacaaccagctcgcctacgtcgtgatcgggatcctgacgctggccgccatcgtggccgcgaacgagatgggcctcctggagaccaccaagcgcgacctgggcatgtccaaggagcccggggtcgtgagcccgacctcctacctcgacgtggacctgcaccccgccagcgcctggacgctgtacgccgtcgcgaccaccgtgatcacccccatgctccggcacacgatcgagaactccaccgccaacgtgagcctggccgccatcgccaaccaggcggtcgtgctgatgggcctcgacaaggggtggcccatctccaaggtggacctgggcgtcccgctgctcgccctggggtgctacagccaggtgaaccccctgaccctcaccgccgccgtgctgctgctcgtcacgcactacgccatcatcggccccggcctgcaggcgaaggccacccgcgaggcccagaagcggaccgccgccgggatcatgaagaaccccaccgtggacggcatcatgacgatcgacctggacccggtgatctacgactccaagttcgagaagcagctcgggcaggtcatgctgctggtgctctgcgcggtgcagctgctgctcatgcgcaccagctgggccttctgcgaggccctgaccctggccaccggccccatcacgaccctctgggagggctcccccgggaagttctggaacaccaccatcgcggtcagcatggccaacatcttccggggctcctacctggccggggccggcctggccttcagcatcatgaagtccgtggggacgggcaagcgcggcaccgggagccagggcgagaccctcggggagaagtggaagaagaagctgaaccagctgagccggaaggagttcgacctctacaagaagtccggcatcaccgaggtggaccgcacggaggcgaaggaggggctgaagcggggcgagaccacccaccacgccgtcagccgcggctccgccaagctgcagtggttcgtggagcggaacatggtgatccccgaggggcgcgtcatcgacctcggctgcgggcggggcgggtggagctactactgcgccggcctgaagaaggtgaccgaggtgcgcggctacaccaagggcgggccggggcacgaggagcccgtccccatgtccacgtacggctggaacatcgtgaagctgatgagcgggaaggacgtgttctacctcccgcccgagaagtgcgacaccctgctgtgcgacatcggcgagtccagcccctcccccaccgtcgaggagagccggaccatccgcgtgctgaagatggtggagccctggctcaagaacaaccagttctgcatcaaggtcctgaacccctacatgcccacggtgatcgagcacctggagcgcctccagcggaagcacggcgggatgctggtccgcaaccccctgtcccggaacagcacccacgagatgtactggatctccaacggcaccgggaacatcgtgagctccgtgaacatggtcagccgcctcctgctgaaccggttcaccatgacgcaccgccggcccaccatcgagaaggacgtggacctcggcgccggcacccgccacgtgaacgcggagccggagacccccaacatggacgtcatcggggagcggatccgccggatcaaggaggagcactccagcacgtggcactacgacgaggagaacccctacaagacctgggcctaccacggctcctacgaggtgaaggccaccgggagcgccagctccatgatcaacggcgtggtcaagctgctgaccaagccgtgggacgtggtgcccacggtcacccagatggccatgaccgacaccacgcccttcgggcagcagcgcgtgttcaaggagaaggtggacacccggacgccccgcccgatgcccggcacccggaaggcgatggagatcaccgccgagtggctctggcgcaccctgggccggaacaagcgcccccggctgtgcacccgcgaggagttcaccaagaaggtccgcacgaacgccgccatgggggcggtgttcaccgaggagaaccagtgggacagcgcccgggccgccgtggaggacgaggagttctggaagctcgtcgaccgcgagcgggagctgcacaagctgggcaagtgcgggtcctgcgtgtacaacatgatgggcaagcgcgagaagaagctcggggagttcggcaaggccaagggcagccgggcgatctggtacatgtggctgggggcccgctacctggagttcgaggccctcggcttcctgaacgaggaccactggttctcccgggagaacagcttctccggggtggagggcgaggggctgcacaagctcggctacatcctgcgcgacatcagcaagatccccggcggggccatgtacgccgacgacaccgcgggctgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaaggggacggtcatggacatcatctcccgcaaggaccagcggggcagcggccaggtggggacctacggcctgaacaccttcaccaacatggaggtgcagctcatccgccagatggagggggagggcgtcctgtccaaggccgacctggagaacccccacctcctggagaaggagatcacccagtggctggagacgaagggggtggagcggctcaagcgcatggccatcagcggcgacgactgcgtggtcaagccgatcgacgaccggttcgcggacgccctgctggccctcaacgacatgggcaaggtgcgcaaggacatcccccagtggcagccctccaaggggtggcacgactggcagcaggtccccttctgcagccaccacttccacgagctgatcatgaaggacggccggaagctggtcgtgccgtgccgcccccaggacgagctcatcgggcgggcccgcatctcccagggcgccgggtggagcctgaaggagaccgcgtgcctgggcaaggcctacgcccagatgtgggccctcatgtacttccaccgccgggacctgcgcctggcgtccaacgccatctgcagcgccgtgcccgtccactgggtgcccacctcccggaccacgtggagcatccacgcccaccaccagtggatgaccaccgaggacatgctcaccgtgtggaaccgcgtctggatcgaggacaacccgtggatggaggacaagacgcccgtgaccacctgggaggacgtgccctacctgggcaagcgggaggaccagtggtgcgggagcctgatcggcctcgcctcccgcgcgacctgggcccagaacatcctgacggccatccagcaggtccggagcctgatcgggaacgaggagttcctcgactacatgccctccatgaagcgcttccggaaggaggaggagagcgagggcgccatctggtga

SEQ ID NO: 10354 - RNA, 9873 nt, synthetic construct
  misc_feature 1..9873: note = derived and/or modified CDS sequence (opt1) from DENV-3__KC762690__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcggcaggtcgagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagttcatcgagggcaaggtcgtgcagcacgagaacctcaagtacaccgtgatcatcacggtccacaccggggaccagcaccaggtgggcaacgagacccagggggtcaccgccgagatcacgccccaggccagcaccgtggaggcgatcctgcccgagtacggcaccctggggctcgagtgcagcccccgcaccggcctggacttcaacgagatgatcctgctcaccatgaagaacaaggcctggatggtgcaccggcagtggttcttcgacctgccgctgccctggacgagcggcgccaccaccgagacccccacgtggaacaagaaggagctcctggtcaccttcaagaacgcccacgccaagaagcaggaggtggtggtcctggggtcccaggagggcgcgatgcacaccgccctcaccggggccacggagatccagaccagcggcgggacctccatcttcgccggccacctgaagtgccgcctgaagatggacaagctcgagctgaagggcatgagctacgccatgtgcctgaacgcgttcgtgctcaagaaggaggtgtccgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagagcaacatcgtgatcggcatcggggacaaggccctgaagatcaactggtacaagaagggctccagcatcgggaagatgttcgaggccacggcccgcggcgcccggcgcatggcgatcctcggcgacaccgcctgggacttcgggtccgtgggcggggtcctgaacagcctgggcaagatggtgcaccagatcttcgggtccgcctacaccgccctcttcagcggcgtgtcctggatcatgaagatcggcatcggggtcctgctgacctggatcggcctcaacagcaagaacacgtccatgagcttctcctgcatcgtgatcgggatcatcaccctgtacctgggcgccgtggtccaggcggacatggggtgcgtgatcaactggaagggcaaggagctcaagtgcggcagcgggatcttcgtgaccaacgaggtccacacctggacggagcagtacaagttccaggccgactcccccaagcggctggccaccgccatcgccggcgcgtgggagaacggggtgtgcggcatccgcagcaccacccgcatggagaacctgctctggaagcagatcgccaacgagctgaactacatcctgtgggagaacaacatcaagctcacggtggtcgtgggggacatcatcggcgtgctggagcagggcaagcggaccctgacgccccagcccatggagctcaagtactcctggaagacctgggggaaggccaagatcgtcacggccgagacccagaacagctccttcatcatcgacggcccgaacacccccgagtgccccagcgcgtcccgcgcctggaacgtgtgggaggtggaggactacgggttcggcgtcttcaccacgaacatctggctgaagctgcgggagatgtacacccagctctgcgaccaccgcctgatgagcgccgccgtgaaggacgagcgggccgtgcacgcggacatgggctactggatcgagagccagaagaacgggtcctggaagctggagaaggccagcctcatcgaggtcaagacctgcacctggcccaagtcccacaccctgtggagcaacggcgtgctggagtccgacatgatcatccccaagtccctcgccgggcccgtgtcccagcacaactaccgccccggctaccacacgcagaccgccgggccgtggcacctgggcaagctggagctcgacttcaactactgcgagggcaccaccgtcgtgatcacggagaactgcgggacccggggccccagcctgcgcaccaccacggtgtccgggaagctgatccacgagtggtgctgccggagctgcaccctgccgcccctccgctacatgggcgaggacgggtgctggtacggcatggagatccggccgatcaacgagaaggaggagaacatggtcaagtccctggtgagcgccggctccgggaaggtggacaacttcaccatgggcgtcctctgcctggcgatcctgttcgaggaggtgatgcgcgggaagttcggcaagaagcacatgatcgccggggtcctgttcaccttcgtcctgctgctcagcggccagatcacgtggcgggacatggcccgcaccctgatcatgatcggctccaacgccagcgaccggatggggatgggcgtgacctacctggccctcatcgcgaccttcaagatccagcccttcctggccctggggttcttcctccgcaagctgacgtcccgggagaacctgctcctgggcgtgggcctggccatggccaccaccctccagctgcccgaggacatcgagcagatggcgaacgggatcgccctgggcctcatggccctgaagctgatcacccagttcgagacgtaccagctctggaccgccctggtcagcctgatgtgcagcaacaccatcttcaccctcacggtggcctggcgcaccgcgaccctgatcctggccgggatctccctcctgcccgtctgccagagctccagcatgcggaagaccgactggctgccggtgacggtggccgccatgggcgtgccgcccctccccctgttcatcttctccctgaaggacaccctcaagcgccgcagctggccgctgaacgagggggtgatggccgtgggcctggtctccatcctcgcgagctccctgctgcggaacgacgtgcccatggccggccccctcgtggccgggggcctgctgatcgcctgctacgtcatcaccgggaccagcgccgacctcacggtggagaaggcggccgacgtgatctgggaggaggaggccgagcagaccggcgtctcccacaacctgatgatcaccgtggacgacgacgggaccatgcgcatcaaggacgacgagacggagaacatcctgaccgtgctcctgaagaccgccctgctcatcgtcagcggcatcttcccctactccatcccggccaccctgctggtgtggcacacctggcagaagcagacgcagcggagcggcgtgctctgggacgtccccagcccgcccgagacccagaaggcggagctggaggagggggtgtaccgcatcaagcagcagggcatcttcgggaagacccaggtgggcgtcggggtgcagaaggagggcgtgttccacaccatgtggcacgtcacgcggggcgccgtgctgacccacaacgggaagcgcctcgagccgaactgggccagcgtgaagaaggacctgatctcctacggcgggggctggcggctgagcgcccagtggcagaagggggaggaggtccaggtgatcgcggtggagcccggcaagaaccccaagaacttccagaccatgcccggcatcttccagaccacgaccggggagatcggcgccatcgccctggacttcaagccggggacctccggcagccccatcatcaaccgcgagggcaaggtcgtggggctctacggcaacggggtggtcaccaagaacggcgggtacgtgagcggcatcgcccagacgaacgccgagcccgacggcccgacccccgagctggaggaggagatgttcaagaagcggaacctgaccatcatggacctccaccccgggtccggcaagacccgcaagtacctgcccgcgatcgtgcgggaggccatcaagcgccggctgcgcacgctcatcctggccccgacccgggtcgtggccgccgagatggaggaggcgctgaaggggctccccatccgctaccagaccaccgccaccaagagcgcccacaccggcaaggagatcgtggacctgatgtgccacgccaccttcaccatgcggctgctctcccccgtccgcgtgcccaactacaacctgatcatcatggacgaggcccacttcacggacccggcgagcatcgccgcccgggggtacatctccacccgcgtgggcatgggcgaggccgcggccatcttcatgaccgccacgccgcccgggacggccgacgccttcccccagagcaacgcgccgatccaggacgaggagcgggacatccccgagcgctcctggaacagcggcaacgagtggatcaccgacttcgccgggaagaccgtctggttcgtgccctccatcaaggccggcaacgacatcgccaactgcctgcgcaagaacgggaagaaggtgatccagctcagccggaagaccttcgacacggagtaccagaagaccaagctgaacgactgggacttcgtcgtgaccaccgacatctccgagatgggcgccaacttcaaggcggaccgcgtgatcgacccccggcgctgcctgaagccggtcatcctcacggacggccccgagcgggtgatcctggccgggcccatgcccgtgaccgtcgccagcgccgcccagcgccggggccgcgtggggcggaacccgcagaaggagaacgaccagtacatcttcaccggccagcccctgaacaacgacgaggaccacgcgcactggaccgaggccaagatgctcctggacaacatcaacacgcccgaggggatcatccccgccctgttcgagccggagcgcgagaagtccgccgcgatcgacggcgagtaccggctcaagggcgagagccgcaagaccttcgtcgagctgatgcggcgcggggacctgcccgtgtggctcgcccacaaggtggcctccgagggcatcaagtacaccgaccggaagtggtgcttcgacggggagcgcaacaaccagatcctggaggagaacatggacgtcgagatctggaccaaggagggcgagaagaagaagctgcggccccgctggctcgacgcccggacctacagcgaccccctggccctgaaggagttcaaggacttcgcggccggccgcaagtccatcgccctcgacctggtgacggagatcgggcgcgtgccgagccacctggcccaccggacccgcaacgccctcgacaacctggtcatgctgcacacctccgagcacggcgggcgggcgtaccgccacgccgtggaggagctccccgagaccatggagacgctgctgctcctgggcctgatgatcctcctgaccgggggcgccatgctgttcctcatcagcggcaaggggatcggcaagaccagcatcgggctgatctgcgtggtcgcctccagcggcatgctgtggatggccgacgtgcccctccagtggatcgcgtccgccatcgtgctggagttcttcatgatggtcctgctcatcccggagcccgagaagcagcggacgccccaggacaaccagctggcctacgtggtgatcgggatcctgacgctcgccgccatcgtcgcggccaacgagatgggcctgctggagaccaccaagcgcgacctcggcatgagcaaggagcccggggtggtgtccccgaccagctacctggacgtcgacctgcaccccgcctccgcctggacgctctacgcggtggccaccaccgtgatcacccccatgctgcggcacacgatcgagaacagcaccgccaacgtctccctggccgccatcgcgaaccaggccgtggtgctcatgggcctggacaaggggtggcccatcagcaagatggacctgggcgtcccgctcctggccctggggtgctactcccaggtgaaccccctcaccctgaccgccgccgtgctgctcctggtcacgcactacgcgatcatcggccccggcctgcaggccaaggccacccgcgaggcccagaagcggaccgccgcggggatcatgaagaaccccaccgtggacggcatcatgacgatcgacctcgacccggtgatctacgacagcaagttcgagaagcagctggggcaggtcatgctgctcgtgctgtgcgccgtgcagctgctcctgatgcgcacctcctgggccttctgcgaggccctgaccctcgcgaccggccccatcacgaccctgtgggagggcagccccgggaagttctggaacaccaccatcgccgtctccatggccaacatcttccggggcagctacctggccggggccggcctcgcgttctccatcatgaagtccgtggggacgggcaagcgcggcaccgggtcccagggcgagaccctgggggagaagtggaagaagaagctgaaccagctcagccggaaggagttcgacctgtacaagaagtccggcatcaccgaggtggaccgcacggaggccaaggaggggctgaagcggggcgagatcacccaccacgccgtctcccgcggcagcgccaagctccagtggttcgtggagcggaacatggtgatccccgaggggcgcgtcatcgacctgggctgcgggcggggcgggtggtcctactactgcgccggcctgaagaaggtgaccgaggtgcgcggctacaccaagggcgggccggggcacgaggagcccgtccccatgagcacctacggctggaacatcgtgaagctcatgtccgggaaggacgtgttctacctgcccccggagaagtgcgacacgctgctgtgcgacatcggcgagagctcccccagccccaccgtcgaggagtcccggaccatccgcgtgctcaagatggtggagccctggctgaagaacaaccagttctgcatcaaggtcctgaacccgtacatgcccaccgtgatcgagcacctcgagcgcctgcagcggaagcacggcgggatgctggtgcgcaaccccctcagccggaactccacgcacgagatgtactggatcagcaacggcaccgggaacatcgtctccagcgtgaacatggtctcccgcctgctgctcaaccggttcaccatgacccaccgccggcccacgatcgagaaggacgtggacctgggcgcgggcacccgccacgtgaacgccgagccggagacccccaacatggacgtcatcggggagcggatccgccggatcaaggaggagcacagctccacctggcactacgacgaggagaacccctacaagacgtgggcctaccacggcagctacgaggtgaaggccaccgggtccgccagcagcatgatcaacggcgtggtcaagctgctcaccaagccgtgggacgtggtgcccaccgtcacgcagatggcgatgaccgacaccacccccttcgggcagcagcgcgtgttcaaggagaaggtggacacgcggacgccccgcccgatgcccggcacccggaaggccatggagatcaccgccgagtggctgtggcgcaccctgggccggaacaagcgcccccggctctgcacccgcgaggagttcaccaagaaggtccgcaccaacgccgcgatgggggccgtgttcacggaggagaaccagtgggactccgcccgggccgccgtggaggacgaggagttctggaagctggtcgaccgcgagcgggagctgcacaagctcggcaagtgcgggagctgcgtgtacaacatgatgggcaagcgcgagaagaagctgggggagttcggcaaggcgaagggctcccgggccatctggtacatgtggctgggggcccgctacctcgagttcgaggccctgggcttcctgaacgaggaccactggttcagccgggagaactccttcagcggggtggagggcgaggggctccacaagctgggctacatcctgcgcgacatctccaagatccccggcggggccatgtacgcggacgacaccgccggctgggacacccggatcaccgaggacgacctccacaacgaggagaagatcacgcagcagatggagccggagcaccgccagctggccaacgccatcttcaagctgacctaccagaacaaggtcgtgaaggtgcagcggcccacccccaaggggaccgtcatggacatcatcagccgcaaggaccagcggggctccggccaggtggggacgtacggcctcaacaccttcaccaacatggaggtgcagctgatccgccagatggagggggagggcgtcctgagcaaggccgacctcgagaacccccacctcctggagaaggagatcacccagtggctcgagaccaagggggtggagcggctgaagcgcatggcgatctccggcgacgactgcgtggtcaagccgatcgacgaccggttcgccgacgccctgctcgccctgaacgacatgggcaaggtgcgcaaggacatcccccagtggcagcccagcaaggggtggcacgactggcagcaggtccccttctgctcccaccacttccacgagctgatcatgaaggacggccggaagctcgtcgtgccgtgccgcccccaggacgagctgatcgggcgggcccgcatcagccagggcgcggggtggtccctgaaggagacggcctgcctcggcaaggcctacgcccagatgtgggcgctgatgtacttccaccgccgggacctgcgcctcgccagcaacgccatctgctccgccgtgcccgtccactgggtgcccaccagccggaccacctggtccatccacgcccaccaccagtggatgacgaccgaggacatgctgaccgtgtggaaccgcgtctggatcgaggacaacccgtggatggaggacaagacccccgtgacgacctgggaggacgtgccctacctgggcaagcgggaggaccagtggtgcgggagcctcatcggcctggcgagccgcgccacctgggcccagaacatcctgaccgccatccagcaggtccggtccctcatcgggaacgaggagttcctggactacatgcccagcatgaagcgcttccggaaggaggaggagtccgagggcgccatctggtga

SEQ ID NO: 10355 - RNA, 9873 nt, synthetic construct
  misc_feature 1..9873: note = derived and/or modified CDS sequence (opt1) from DENV-3__KC762691__SS-prME
  source 1..9873: mol_type = other RNA
accagcctgtgcctcatgatgatgctgcccgccaccctggccttccacctcacctcccgcgacggggagccccggatgatcgtggggaagaacgagcgcggcaagagcctgctgttcaagaccgcctccgggatcaacatgtgcaccctcatcgccatggacctgggcgagatgtgcgacgacaccgtgacgtacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcggcaggtcgagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgcagcccccggaccggcctggacttcaacgagatgatcctcctgaccatgaaggacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacaccatgtgctccaacgccttcgtgctcaagaaggaggtgagcgagacgcagcacgggaccatcctgatcaaggtcgagtacaagggcgaggacgcgccctgcaagatcccgttcagcaccgaggacgggcagggcaaggcccacaacggccggctgatcaccgccaaccccgtggtgacgaagaaggaggagcccgtcaacatcgaggccgagcccccgttcggggagtccaacatcatcatcggcatcggggacaaggcgctgaagatcaactggtacaagaagggcagctccatcgggaagatgttcgaggccaccgcccgcggcgcccggcgcatggccatcctcggcgacaccgcgtgggacttcgggagcgtgggcggggtgctgaactccctgggcaagatggtccaccagatcttcgggagcgcctacaccgccctcttctccggcgtgagctggatcatgaagatcggcatcggggtgctgctgacgtggatcggcctcaactccaagaacaccagcatgtccttcagctgcatcgtcatcgggatcatcaccctgtacctgggcgccgtggtgcaggccgacatggggtgcgtcatcaactggaagggcaaggagctcaagtgcggctccgggatcttcgtgaccaacgaggtgcacacgtggaccgagcagtacaagttccaggcggacagcccccggcgcctggccaccgccatcgccggcgcctgggagaacggggtctgcggcatccgctccaccacgcggatggagaacctgctctggaagcagatcgcgaacgagctgaactacatcctgtgggagaacaacatcaagctcaccgtggtggtcggggacaccatcggcgtgctggagcagggcaagcgcaccctgacgccccagcccatggagctcaagtacagctggaagacctgggggaaggccaagatcgtgaccgccgagacccagaactccagcttcatcatcgacggcccgaacacgcccgagtgccccaacgcctcccgggcgtggaacgtctgggaggtggaggactacgggttcggcgtgttcaccaccaacatctggctgaagctgcgcgagatgtacacccagctctgcgaccaccggctgatgagcgccgccgtcaaggacgagcgcgccgtgcacgccgacatgggctactggatcgagagccagaagaacgggtcctggaagctggagaaggcgagcctcatcgaggtgaagacctgcacgtggcccaagtcccacaccctgtggagcaacggcgtcctggagtccgacatgatcatccccaagtccctcgccgggcccatctcccagcacaactaccggcccggctaccacacccagaccgccgggccgtggcacctgggcaagctggagctcgacttcaactactgcgagggcacgaccgtggtgatcaccgagaactgcggggcccgcggccccagcctgcggaccacgaccgtctccgggaagctgatccacgagtggtgctgccgcagctgcaccctgccgcccctccggtacatgggcgaggacgggtgctggtacggcatggagatccgcccgatcaacgagaaggaggagaacatggtgaagtccctggtgagcgccggctccgggaaggtcgacaacttcaccatgggcgtgctctgcctggcgatcctgttcgaggaggtgatgcgggggaagttcggcaagaagcacatgatcgccggggtcctcttcacgttcgtgctgctgctcagcggccagatcacctggcgcgacatggcccggaccctgatcatgatcggctccaacgccagcgaccgcatggggatgggcgtgacctacctggccctcatcgcgacgttcaagatccagcccttcctggccctggggttcttcctccggaagctgacctcccgcgagaacctgctcctgggcgtcggcctggccatggccaccaccctccagctgcccgaggacatcgagcagatggcgaacgggatcgccctgggcctcatggccctgaagctgatcacgcagttcgagacctaccagctctggaccgccctggtgagcctgatgtgcagcaacaccatcttcacgctcaccgtggcctggcggaccgcgaccctgatcctggccgggatctccctcttccccgtctgccagagctccagcatgcgcaagacggactggctgccgatgaccgtggccgccatgggcgtgccgcccctgcccctcttcatcttctccctgaaggacaccctgaagcgccggagctggccgctcaacgagggggtgatggccgtgggcctggtctccatcctggcgagctccctcctgcgcaacgacgtgcccatggccggccccctggtggccgggggcctcctgatcgcctgctacgtcatcaccgggacgagcgccgacctgaccgtggagaaggcggccgacgtgacctgggaggaggaggccgagcagaccggcgtctcccacaacctcatgatcacggtggacgacgacgggaccatgcggatcaaggacgacgagaccgagaacatcctgaccgtgctgctcaagaccgccctgctgatcgtcagcggcatcttcccctactccatcccggccacgctcctggtgtggcacacctggcagaagcagacccagcgcagcggcgtgctgtgggacgtccccagcccgcccgagacccagaaggcggagctcgaggagggggtgtaccggatcaagcagcagggcatcttcgggaagacccaggtgggcgtcggggtgcagaaggagggcgtgttccacaccatgtggcacgtcacccgcggcgccgtgctgacctacaacgggaagcggctggagccgaactgggccagcgtgaagaaggacctcatctcctacggcgggggctggcgcctgagcgcccagtggcagaagggggaggaggtccaggtgatcgcggtggagcccggcaagaaccccaagaacttccagacgatgcccggcatcttccagaccaccaccggggagatcggcgccatcgccctggacttcaagccggggacgtccggcagccccatcatcaaccgggagggcaaggtcgtggggctgtacggcaacggggtggtcaccaagaacggcgggtacgtgagcggcatcgcccagaccaacgccgagcccgacggcccgacccccgagctcgaggaggagatgttcaagaagcgcaacctgacgatcatggacctgcaccccgggtccggcaagacccggaagtacctccccgcgatcgtgcgcgaggccatcaagcggcgcctgcggaccctgatcctcgccccgacccgcgtcgtggccgccgagatggaggaggcgctgaaggggctgcccatccggtaccagacgaccgccaccaagagcgagcacaccggcaaggagatcgtggacctcatgtgccacgccacgttcaccatgcgcctgctgtcccccgtccgggtgcccaactacaacctcatcatcatggacgaggcccacttcaccgacccggccagcatcgcggcccgcgggtacatctccacccgggtgggcatgggcgaggccgccgcgatcttcatgacggccacgccgcccgggaccgccgacgccttcccccagagcaacgccccgatccaggacgaggagcgcgacatccccgagcgctcctggaacagcggcaacgactggatcaccgacttcgcggggaagacggtctggttcgtgccctccatcaaggccggcaacgacatcgccaactgcctgcggaagaacgggaagaaggtgatccagctgagccgcaagaccttcgacaccgagtaccagaagaccaagctcaacgactgggacttcgtcgtgacgaccgacatctccgagatgggcgccaacttcaaggccgaccgggtgatcgacccccgccggtgcctgaagccggtcatcctgaccgacggccccgagcgcgtgatcctcgcggggcccatgcccgtgaccgtcgccagcgccgcccagcggcgcggccggatcgggcgcaacccgcagaaggagaacgaccagtacatcttcacgggccagcccctgaacaacgacgaggaccacgcccactggaccgaggcgaagatgctgctcgacaacatcaacacccccgaggggatcatccccgccctgttcgagccggagcgggagaagtccgccgccatcgacggcgagtaccgcctgaagggcgagagccggaagaccttcgtggagctcatgcgccgcggggacctgcccgtgtggctggcgcacaaggtcgcctccgagggcatcaagtacaccgaccgcaagtggtgcttcgacggggagcggaacaaccagatcctcgaggagaacatggacgtggagatctggacgaaggagggcgagaagaagaagctgcgcccccggtggctggacgcccgcacctacagcgaccccctcgccctgaaggagttcaaggacttcgccgcgggccgcaagtccatcgccctggacctcgtcaccgagatcgggcgggtgccgagccacctggcccaccgcacccggaacgccctggacaacctcgtgatgctgcacacgtccgagcacggcgggcgcgcctaccggcacgcggtcgaggagctgcccgagaccatggagaccctcctgctgctcggcctgatgatcctgctcaccgggggcgccatgctgttcctgatcagcggcaagggggtgggcaagacgagcatcgggctcatctgcgtggtcgcctccagcggcatgctgtggatggccgacatccccctgcagtggatcgcctccgcgatcgtgctcgagttcttcatgatggtgctgctgatcccggagcccgagaagcagcgcacgccccaggacaaccagctcgcctacgtcgtgatcgggatcctgaccctggccgccatcgtggccgcgaacgagatgggcctcctggagaccacgaagcgggacctgggcatgagcaaggagcccggggtcgtgtccccgaccagctacctcgacgtggacctgcaccccgcctccgcctggaccctgtacgccgtcgcgaccacggtgatcacccccatgctccgccacaccatcgagaacagcaccgccaacgtgtccctggccgccatcgccaaccaggcggtcgtgctgatgggcctcgacaaggggtggcccatcagcaagatggacctgggcgtgccgctgctcgccctggggtgctactcccaggtcaaccccctgacgctcaccgccgccgtgctgctgctcgtgacccactacgccatcatcggccccggcctgcaggcgaaggccacccgggaggcccagaagcgcacggccgccgggatcatgaagaaccccaccgtcgacggcatcatgaccatcgacctggacccggtgatctacgacagcaagttcgagaagcagctcggccaggtgatgctgctggtcctctgcgcggtgcagctgctgctcatgcggacctcctgggccttctgcgaggccctgacgctggccaccggccccatcaccaccctctgggagggcagccccgggaagttctggaacacgaccatcgcggtgtccatggccaacatcttccgcggcagctacctggccggggccggcctggccttctccatcatgaagtccgtcgggaccggcaagcggggcaccgggagccagggcgagacgctcggggagaagtggaagaagaagctgaaccagctgagccgcaaggagttcgacctctacaagaagtccggcatcaccgaggtggaccggaccgaggcgaaggaggggctgaagcgcggcgagatcacccaccacgccgtgtcccggggcagcgccaagctgcagtggttcgtcgagcgcaacatggtgatccccgaggggcgggtgatcgacctcggctgcgggcgcggcgggtggtcctactactgcgccggcctgaagaaggtcaccgaggtgcggggctacacgaagggcgggccggggcacgaggagcccgtgcccatgagcacctacggctggaacatcgtcaagctgatgtccgggaaggacgtgttctacctcccgcccgagaagtgcgacaccctgctgtgcgacatcggcgagagctcccccagccccaccgtggaggagtcccgcacgatccgcgtcctgaagatggtggagccctggctcaagaacaaccagttctgcatcaaggtgctgaacccctacatgcccaccgtcatcgagcacctggagcggctccagcgcaagcacggcgggatgctggtgcggaaccccctgagccgcaactccacccacgagatgtactggatcagcaacggcaccgggaacatcgtgtccagcgtcaacatggtgtcccggctcctgctgaaccgcttcacgatgacctaccggcgccccaccatcgagaaggacgtggacctcggcgccggcacccggcacgtcaacgcggagccggagacgcccaacatggacgtgatcggggagcgcatccggcgcatcaaggaggagcacagctccacctggcactacgacgacgagaacccctacaagacctgggcctaccacggcagctacgaggtcaaggccaccgggtccgccagcagcatgatcaacggcgtggtgaagctgctgacgaagccgtgggacgtcgtgcccaccgtgacccagatggccatgaccgacacgacccccttcgggcagcagcgggtcttcaaggagaaggtggacacccgcacccccaagccgatgcccggcacgcggaaggtgatggagatcaccgcggagtggctctggcgcaccctgggccggaacaagcgcccccggctgtgcacccgcgaggagttcacgaagaaggtccgcaccaacgccgccatgggggccgtgttcaccgaggagaaccagtgggactccgcgcgggccgccgtggaggacgaggagttctggaagctcgtcgaccgcgagcgggagctgcacaagctgggcaagtgcgggagctgcgtgtacaacatgatgggcaagcgcgagaagaagctcggggagttcggcaaggccaagggctcccgggccatctggtacatgtggctgggggcgcgctacctggagttcgaggccctcggcttcctgaacgaggaccactggttcagccgggagaactcctacagcggggtggagggcgaggggctgcacaagctcggctacatcctgcgcgacatctccaagatccccggcggggccatgtacgccgacgacaccgccggctgggacacgcggatcaccgaggacgacctgcacaacgaggagaagatcacccagcagatggacccggagcaccgccagctcgcgaacgccatcttcaagctgacctaccagaacaaggtcgtgaaggtgcagcggcccacgcccaaggggaccgtcatggacatcatcagccgcaaggaccagcggggctccggccaggtggggacctacggcctgaacaccttcaccaacatggaggcccagctcatccgccagatggagggggagggcgtgctgagcaagacggacctggagaacccccacctcctggagaagaagatcacccagtggctggagaccaagggggtcgagcggctcaagcgcatggccatctccggcgacgactgcgtggtgaagccgatcgacgaccggttcgccaacgcgctgctggccctcaacgacatgggcaaggtccgcaaggacatcccccagtggcagcccagcaaggggtggcacgactggcagcaggtccccttctgctcccaccacttccacgagctgatcatgaaggacggccggaagctggtggtcccgtgccgcccccaggacgagctcatcgggcgggcccgcatcagccagggcgccgggtggtccctgaaggagaccgcctgcctgggcaaggcgtacgcccagatgtgggccctcatgtacttccaccgccgggacctgcgcctggccagcaacgcgatctgctccgccgtgcccgtgcactgggtccccacgagccggaccacctggtccatccacgcccaccaccagtggatgaccacggaggacatgctcaccgtgtggaaccgcgtgtggatcgaggacaacccgtggatggaggacaagacccccgtcaccacgtgggaggacgtgccctacctgggcaagcgggaggaccagtggtgcgggagcctgatcggcctcaccagccgcgccacctgggcccagaacatcctgaccgcgatccagcaggtccggtccctgatcgggaacgaggagttcctcgactacatgcccagcatgaagcgcttccggaaggaggaggagtccgagggcgccatctggtga

SEQ ID NO: 10356 - RNA, 9873 nt, synthetic construct
  misc_feature 1..9873: note = derived and/or modified CDS sequence (opt1) from DENV-3__KC762692__SS-prME
  source 1..9873: mol_type = other RNA
accagcctgtgcctcatgatgatgctgcccgccaccctggccttccacctcacctcccgcgacggcgagccccggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggcggacatggggtgcgtcatcaactggaagggcaaggagctcaagtgcggctccgggatcttcgtgaccaacgaggtgcacacctggacggagcagtacaagttccaggccgacagccccaagcggctggccaccgccatcgtcggcgcctgggagaacggggtgtgcggcatccgctccaccacccgcatggagaacctgctctggaagcagatcgcgaacgagctgaactacatcctgtgggagaacaacatcaagctcacggtggtcgtgggggacatcatcggcgtgctggagcagggcaagcggaccctgacgccccagcccatggagctcaagtacagctggaagacctgggggaaggccaagatcgtcacggccgagatccagaactccagcttcatcatcgacggcccgaacacccccgagtgccccaacgcctcccgcgcgtggaacgtgtgggaggtggaggactacgggttcggcgtcttcaccaccaacatctggctgaagctgcgggagatgtacacgcagctctgcgaccaccgcctgatgagcgccgccgtgaaggacgagcgggccgtgcacgccgacatgggctactggatcgagagccagaagaacgggtcctggaagctggagaaggcgagcctcatcgaggtcaagacctgcacctggcccaagtcccacaccctgtggagcaacggcgtgctggagtccgacatgatcatccccaagtccctcgccgggcccatctcccagcacaactaccgccccggctaccacacccagacggccgggccgtggcacctgggcaagctggagctcgacttcaactactgcgagggcaccaccgtggtcatcaccgagaactgcgggacgcggggccccagcctgcgcaccaccaccgtgtccgggaagctgatccacgagtggtgctgccggagctgcacgctgccgcccctccgctacatgggcgaggacgggtgctggtacggcatggagatccggccgatcaacgagaaggaggagaacatggtgaagtccctggtcagcgccggctccgggaaggtggacaacttcaccatgggcgtgctctgcctggccatcctgttcgaggaggtcatgcgcgggaagttcggcaagaagcacatgatcgcgggggtcctcttcatgttcgtgctgctgctcagcggccagatcacctggcgggacatggcccgcaccctgatcatgatcggctccaacgccagcgaccggatggggatgggcgtcacgtacctggccctcatcgccaccttcaagatccagcccttcctggcgctggggttcttcctccgcaagctgacctcccgggagaacctgctcctgggcgtgggcctggccatggccaccacgctccagctgcccgaggacatcgagcagatggccaacgggatcgcgctgggcctcatggtgctgaagctgatcacccagttcgagacctaccagctctggaccgccctggtcagcctgacgtgcagcaacaccatcttcaccctcaccgtggcctggcgcacggccaccctgatcctggccgggacctccctcctgcccgtctgccagagctccagcatgcggaagaccgactggctgccgatgacggtggcggccatgggcgtgccgcccctccccctgttcatcttctccctgaaggacaccctcaagcgccgcagctggccgctgaacgagggggtcatggccgtgggcctggtgtccatcctcgccagctccctgctgcggaacgacgtccccatggccggccccctcgtggccggcgggctgctgatcgcctgctacgtgatcaccgggaccagcgccgacctcacggtcgagaaggccgccgacgtgacctgggaggaggaggcggagcagaccggggtgtcccacaacctgatgatcaccgtcgacgacgacgggacgatgcgcatcaaggacgacgagaccgagaacatcctgaccgtgctcctgaagaccgccctgctcatcgtgagcggcatcttcccctactccatcccggccaccctgctggtctggcacacgtggcagaagcagacccagcggagcggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgccgtcctgacctacaacgggaagcgcctcgagccgaactgggcgagcgtgaagaaggacctgatctcctacggcgggggctggcggctgagcgcccagtggcagaagggggaggaggtgcaggtcatcgccgtggagcccggcaagaaccccaagaacttccagaccatgcccggcatcttccagacgatcaccggggagatcggcgccatcgcgctggacttcaagccggggacctccggcagccccatcatcaaccgcgagggcaaggtggtcgggctctacggcaacggggtggtgaccaagaacggcgggtacgtcagcggcatcgcccagacgaacgccgagcccgacggcccgacccccgagctggaggaggagatgttcaagaagcggaacctgaccatcatggacctccaccccgggtccggcaagacccgcaagtacctgcccacgatcgtgcgggaggccatcaagcgccggctgcgcaccctcatcctggccccgacccgggtggtcgcggccgagatggaggaggccctgaaggggctccccatccgctaccagaccacggccaccaagagcgagcacaccggcaaggagatcgtggacctgatgtgccacgccaccttcacgatgcggctgctctcccccgtgcgcgtccccaactacaacctgatcatcatggacgaggcgcacttcaccgacccggccagcatcgccgcccgggggtacatctccacccgcgtgggcatgggcgaggccgcggccatcttcatgaccgccacgccgcccgggaccgccgacgcgttcccccagagcaacgccccgatccaggacgaggagcgggacatccccgagcgctcctggaacagcggcaacgactggatcaccgacttcgccgggaagaccgtgtggttcgtcccctccatcaaggccggcaacgacatcgccaactgcctgcgcaagaacgggaagaaggtgatccagctcagccggaagacgttcgacaccgagtaccagaagaccaagctgaacgactgggacttcgtggtcaccacggacatctccgagatgggcgcgaacttcaaggccgaccgcgtgatcgacccccggcgctgcctgaagccggtgatcctcaccgacggccccgagcgggtcatcctggccgggcccatgcccgtgaccgtggccagcgccgcgcagcgccggggccgcgtcgggcggaacccgcagaaggagaacgaccagtacatcttcaccggccagcccctgaacaacgacgaggaccacgcccactggacggaggccaagatgctcctggacaacatcaacacccccgaggggatcatccccgccctgttcgagccggagcgcgagaagtccgccgcgatcgacggcgagtaccggctcaagggcgagagccgcaagaccttcgtggagctgatgcggcgcggggacctgcccgtctggctcgcccacaaggtggcctccgagggcatcaagtacaccgaccggaagtggtgcttcgacggggagcgcaacaaccagatcctggaggagaacatggacgtggagatctggaccaaggagggcgagaagaagaagctgcggccccgctggctcgacgcccggacgtacagcgaccccctggcgctgaaggagttcaaggacttcgccgccggccgcaagtccatcgccctcgacctggtcaccgagatcgggcgcgtgccgagccacctggcccaccggacccgcaacgcgctcgacaacctggtgatgctgcacacctccgagcacggcgggcgggcctaccgccacgccgtcgaggagctccccgagacgatggagaccctgctgctcctgggcctgatgatcctcctgaccgggggcgccatgctgttcctcatcagcggcaagggggtgggcaagaccagcatcgggctgatctgcgtggtcgcctccagcggcatgctgtggatggcggacatccccctccagtggatcgcctccgccatcgtgctggagttcttcatgatggtgctgctcatcccggagcccgagaagcagcggacgccccaggacaaccagctggcctacgtcgtgatcgggatcctgaccctcgccgcgatcgtggccgccaacgagatgggcctgctggagaccaccaagcgcgacctcggcatgagcaaggagcccggggtcgtgtccccgacgagctacctggacgtggacctgcaccccgcctccgcctggaccctctacgcggtcgccaccaccgtgatcacgcccatgctgcggcacaccatcgagaacagcaccgccaacgtgtccctggccgcgatcgccaaccaggccgtcgtgctcatgggcctggacaaggggtggcccatcagcaagatggacctgggcgtgccgctcctggccctggggtgctactcccaggtcaaccccctcaccctgacggccgcggtgctgctcctggtgacccactacgccatcatcggccccggcctgcaggccaaggccacccgcgaggcccagaagcggaccgcggccgggatcatgaagaaccccacggtcgacggcatcatgaccatcgacctcgacccggtgatctacgacagcaagttcgagaagcagctgggccaggtgatgctgctcgtcctgtgcgccgtgcagctgctcctgatgcgcacctcctgggccttctgcgaggccctgaccctcgcgacgggccccatcaccaccctgtgggagggcagccccgggaagttctggaacaccacgatcgccgtgtccatggccaacatcttccggggcagctacctggccggggcgggcctcgccttctccatcatgaagtccgtcgggaccggcaagcgcggcaccgggagccagggcgagaccctgggggagaagtggaagaagaagctgaaccagctcagccggaaggagttcgacctgtacaagaagtccggcatcacggaggtggaccgcaccgaggccaaggaggggctgaagcggggcgagatcacccaccacgccgtgtcccgcggcagcgccaagctccagtggttcgtcgagcggaacatggtgatccccgaggggcgcgtgatcgacctgggctgcgggcggggcgggtggtcctactactgcgcgggcctgaagaaggtcaccgaggtgcgcggctacaccaagggcgggccggggcacgaggagcccgtgcccatgagcacgtacggctggaacatcgtcaagctcatgtccgggaaggacgtgttctacctgcccccggagaagtgcgacaccctgctgtgcgacatcggcgagagctcccccagccccaccgtggaggagtcccggaccatccgcgtcctcaagatggtggagccctggctgaagaacaaccagttctgcatcaaggtgctgaacccgtacatgcccacggtcatcgagcacctcgagcgcctgcagcggaagcacggcgggatgctggtgcgcaaccccctcagccggaactccacccacgagatgtactggatcagcaacggcaccgggaacatcgtgtccagcgtcaacatggtgtcccgcctgctgctcaaccggttcaccatgacgtaccgccggcccaccatcgagaaggacgtcgacctgggcgccggcacccgccacgtgaacgccgagccggagacccccaacatggacgtgatcggggagcggatccgccggatcaaggaggagcacagctccacgtggcactacgacgacgagaacccctacaagacctgggcctaccacggcagctacgaggtcaaggccaccgggtccgcgagcagcatgatcaacggcgtggtgaagctgctcaccaagccgtgggacgtcgtgcccacggtgacccagatggccatgaccgacaccacgcccttcgggcagcagcgcgtcttcaaggagaaggtggacacccggacccccaagccgatgcccggcacccgcaagatcatggagatcacggccggctggctgtggcggaccctggggcgcaacaagcggccccgcctctgcacccgggaggagttcaccaagaaggtgcgcacgaacgccgccatgggcgcggtcttcaccgaggagaaccagtgggactccgcccgcgccgccgtggaggacgaggagttctggaagctggtggaccgggagcgcgagctgcacaagcaggggaagtgcggcagctgcgtctacaacatgatggggaagcgggagaagaagctcggcgagttcggcaaggcgaaggggtcccgcgccatctggtacatgtggctgggcgcccggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgcggacgacaccgccgggtgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaagggcacggtgatggacatcatcagccggaaggaccagcgcggctccgggcaggtcggcacctacgggctgaacaccttcaccaacatggaggcccagctcatccggcagatggagggcgagggggtgctgagcaagaccgacctggagaacccccacctcctggagaagaagatcacgcagtggctggagaccaagggcgtggagcgcctcaagcggatggcgatctccggcgacgactgcgtcgtgaagccgatcgacgaccgcttcgccaacgccctgctggccctcaacgacatggggaaggtgcggaaggacatcccccagtggcagcccagcaagggctggcacgactggcagcaggtccccttctgctcccaccacttccacgagctgatcatgaaggacgggcgcaacctggtggtgccgtgccggccccaggacgagctcatcggccgcgcccggatcagccagggggcgggctggtccctgaaggagaccgcctgcctgggcaaggcctacgcccagatgtgggccctcatgtacttccaccgccgcgacctgcggctggcgagcaacgccatctgctccgccgtccccgtgcactgggtgcccaccagccgcacgacctggtccatccacgcccaccaccagtggatgaccaccgagaacatgctcacggtctggaaccgggtgtggatcgaggacaacccgtggatggaggacaagacccccgtgaccacctgggaggacgtcccctacctggggaagcgcgaggaccagtggtgcggcagcctgatcgggctcacgagccgggcgacctgggcccagaacatcctgaccgccatccagcaggtccgctccctgatcggcaacgaggagttcctcgactacatgcccagcatgaagcggttccgcaaggaggaggagtccgagggggccatctggtga

SEQ ID NO: 10357 - RNA, 9873 nt, synthetic construct
  misc_feature 1..9873: note = derived and/or modified CDS sequence (opt1) from DENV-3__JQ920481__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccgtcgtggtgggggacgtcatcggcgtgctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtctgggaggtggaggactacgggttcggcgtgttcacgaccaacatctggctgaagctgcgggagatgtacacccagctctgcgaccaccgcctgatgagcgccgccgtcaaggacgagcgggccgtgcacgcggacatgggctactggatcgagtcccagaagaacgggagctggaagctggagaaggcctccctcatcgaggtgaagacctgcacctggcccaagagccacacgctgtggtccaacggcgtcctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtggtgatcaccgagaactgcgggacccggggcccctccctgcgcaccacgaccgtcagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtcctctgcctggccatcctgttcgaggaggtgatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtcacctacctggccctcatcgccacgttcaagatccagcccttcctggccctggggttcttcctccggaagctgaccagccgcgagaacctgctcctgggcgtgggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcttcacgctcaccgtcgcctggcggaccgccaccctgatcctggccgtgatcagcctcctgcccgtgtgccagtccagctccatgcgcaagacggactggctgccgatgaccgtcgccgcgatgggggtgccgcccctccccctgttcatcttcagcctgaaggacaccctcaagcggcgctcctggccgctgaacgagggcgtcatggccgtggggctggtgagcatcctcgcctccagcttcctgcgcaacgacgtccccatggccggccccctggtggccggcgggctcctgatcgcgtgctacgtgatcaccggcacgtccgccgacctgaccgtcgagaaggccgccgacgtgacctgggaggaggaggccgagcagaccggggtgagccacaacctcatgatcacggtcgacgacgacggcaccatgcggatcaaggacgacgagaccgagaacatcctgaccgtgctgctcaagaccgcgctgctgatcgtgtccgggatcttcccctacagcatcccggccacgctcctggtctggcacacctggcagaagcagacccagcgctccggcgtgctgtgggacgtgccctccccgcccgagacccagaaggccgagctcgaggagggcgtctaccggatcaagcagcaggggatcttcggcaagacccaggtgggggtgggcgtccagaaggagggggtgttccacaccatgtggcacgtgacccgcggcgccgtcctgacccacaacggcaagcggctggagccgaactgggcgaacgtgaagaaggacctcatctcctacgggggcgggtggaagctgagcgcccagtggcagaagggcgaggaggtgcaggtcatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtggtcggcctgtacgggaacggcgtggtgaccaagaacgggggctacgtcagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtggtcgcggccgagatggaggaggccctgaagggcctgcccatccgctaccagacgaccgccaccaagagcgagcacaccgggcgggagatcgtggacctcatgtgccacgccacgttcaccatgcgcctgctgtcccccgtgcgggtccccaactacaacctcatcgtgatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtctggttcgtgccctccatcaaggccgggaacgacatcgccaactgcctgcgcaagaacggcaagaaggtgatccagctgagccgcaagaccttcgacaccgagtaccagaagaccaagctcaacgactgggacttcgtcgtgacgaccgacatctccgagatgggggcgaacttcaaggccgaccgggtgatcgacccccgccggtgcctgaagccggtcatcctgaccgacggccccgagcgcgtgatcctcgccggccccatgcccgtgaccgtcgccagcgccgcgcagcggcgcgggcgggtgggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtctggctggcccacaaggtggcctccgaggggatcaagtacaccgaccgcaagtggtgcttcgacggcgagcggaacaaccagatcctcgaggagaacatggacgtcgagatctggacgaaggagggggagaagaagaagctgcgcccccggtggctggacgcccgcacctacagcgaccccctcgcgctgaaggagttcaaggacttcgccgccggccggaagtccatcgccctggacctcgtgaccgagatcggccgcgtgccgagccacctggcccaccgcacccggaacgcgctggacaacctcgtcatgctgcacacgtccgagcacgggggccgcgcctaccggcacgccgtggaggagctgcccgagaccatggagaccctcctgctgctcgggctgatgatcctgctcaccggcggggccatgctgttcctgatcagcggcaagggcatcgggaagacgagcatcggcctcatctgcgtggtcgcctccagcgggatgctgtggatggcggacgtgcccctgcagtggatcgcctccgccatcgtgctcgagttcttcatgatggtcctgctgatcccggagcccgagaagcagcgcacgccccaggacaaccagctcgcctacgtggtgatcggcatcctgaccctggccgcgatcgtcgccgccaacgagatggggctcctggagaccacgaagcgggacctgggcatgagcaaggagcccggcgtggtgtccccgaccagctacctcgacgtcgacctgcaccccgcctccgcgtggaccctgtacgccgtggccaccacggtgatcacccccatgctccgccacaccatcgagaacagcaccgccaacgtctccctggccgcgatcgccaaccaggccgtggtgctgatggggctcgacaagggctggcccatcagcaagatggacctgggggtcccgctgctcgccctgggctgctactcccaggtgaaccccctgacgctcaccgccgcggtgctgctgctcgtcacccactacgccatcatcgggcccggcctgcaggccaaggccacccgggaggcccagaagcgcacggcggccggcatcatgaagaaccccaccgtggacgggatcatgaccatcgacctggacccggtgatctacgacagcaagttcgagaagcagctcggccaggtcatgctgctggtgctctgcgccgtgcagctgctgctcatgcggacctcctgggccttctgcgaggcgctgacgctggccaccgggcccatcaccaccctctgggagggcagccccggcaagttctggaacacgaccatcgccgtctccatggccaacatcttccgcgggagctacctggccggcgcggggctggccttctccatcatgaagtccgtgggcaccgggaagcggggcaccggctcccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtctcccggggcagcgccaagctgcagtggttcgtggagcgcaacatggtgatccccgagggccgggtcatcgacctcgggtgcggccgcgggggctggtcctactactgcgcggggctgaagaaggtgaccgaggtgcggggctacacgaagggcgggccgggccacgaggagcccgtccccatgagcacctacgggtggaacatcgtgaagctgatgtccggcaaggacgtgttctacctcccgcccgagaagtgcgacaccctgctgtgcgacatcggggagagctcccccagccccaccgtcgaggagtcccgcacgatccgggtgctgaagatggtggagccctggctcaagaacaaccagttctgcatcaaggtcctgaacccctacatgcccaccgtgatcgagcacctggagcgcctccagcgcaagcacggcggcatgctggtgcggaaccccctgagccgcaactccacccacgagatgtactggatcagcaacgggaccggcaacatcgtctccagcgtgaacatggtgtcccggctcctgctgaaccgcttcacgatgacccaccggcgccccaccatcgagaaggacgtcgacctcggggccggcacccggcacgtgaacgccgagccggagacgcccaacatggacgtcatcggcgagcgcatccggcgcatcaaggaggagcacagctccacctggcactacgacgacgagaacccctacaagacctgggcctaccacgggagctacgaggtgaaggccaccggctccgcgagcagcatgatcaacggggtggtcaagctgctgacgaagccgtgggacgtggtgcccatggtcacccagatggccatgaccgacaccacgcccttcggccagcagcgggtgttcaaggagaaggtggacacccgcacgccccggccgatgcccgggacccgcaaggtcatggagatcacggccgagtggctctggcggaccctgggccgcaacaagcggccccgcctgtgcacccgggaggagttcatcaagaaggtgcgcaccaacgccgcgatgggcgccgtgttcacggaggagaaccagtgggactccgcccgcgccgccgtcgaggacgaggagttctggaagctcgtggaccgggagcgcgagctgcacaagctggggaagtgcggcagctgcgtgtacaacatgatggggaagcgggagaagaagctcggcgagttcgggaaggcgaagggctcccgcgccatctggtacatgtggctgggcgcccggtacctggagttcgaggccctcgggttcctgaacgaggaccactggttcagccgcgagaactcctacagcggcgtcgagggggagggcctgcacaagctcgggtacatcctgcgggacatctccaagatccccggcggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaagggcaccgtgatggacatcatcagccggaaggaccagcgcgggtccggccaggtgggcacgtacgggctgaacaccttcaccaacatggaggcccagctcatccggcagatggagggcgagggggtcctgagcaaggcggacctggagaacccccacctcctggagaagaaggtgacccagtggctggagaccaagggcgtggagcgcctcaagcggatggccatctccggggacgactgcgtcgtgaagccgatcgacgaccgcttcgccaacgccctgctggccctcaacgacatgggcaaggtgcggaaggacatcccccagtggcagcccagcaagggctggcacgactggcagcaggtccccttctgctcccaccacttccacgagctgatcatgaaggacgggcgcaagctggtggtgccgtgccggccccaggacgagctcatcggccgcgcgcggatcagccagggggccggctggtccctgcgcgagacggcctgcctggggaaggcctacgcgcagatgtgggccctcatgtacttccaccgccgggacctgcgcctggccagcaacgccatctgctccgccgtccccgtgcactgggtgcccaccagccggaccacctggtccatccacgcgcaccaccagtggatgacgaccgaggacatgctcaccgtctggaaccgcgtgtggatcgaggacaacccgtggatggaggacaagacccccgtgacgacctgggaggacgtcccctacctgggcaagcgggaggaccagtggtgcggcagcctgatcgggctcaccagccgcgccacctgggcccagaacatcctgacggccatccagcaggtccggtccctgatcggcaacgaggagttcctcgactacatgcccagcatgaagcgcttccggaaggaggaggagtccgagggggccatctggtga

SEQ ID NO: 10358 - RNA, 9873 nt, synthetic construct
  misc_feature 1..9873: note = derived and/or modified CDS sequence (opt1) from DENV-3__JQ920483__SS-prME
  source 1..9873: mol_type = other RNA
accagcctctgcctcatgatgatgctgcccgccaccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcagaaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagccgcccttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggccccaacacccccgagtgcccctccgcgagccgcgcctggaacgtgtgggaggtcgaggactacgggttcggcgtgttcacgaccaacatctggctgaagctgcgggagaagtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggatccggggcccctccctgcgcaccaccacggtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaagaccgacaacttcaccatgggcgtgctctgcctggcgatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcctccgaccgcatggggatgggcgtgacctacctggcgctcatcgccacgttcaagatccagcccttcctggccctggggttcttcctccggaagctgaccagccgcgagaacctgctcctgggcgtcggcctggccatggcgaccaccctccagctgcccgaggacatcgagcagatggccaacgggatcgccctgggcctcatggccctgaagctgatcacgcagttcgagacctaccagctctggaccgccctgatcagcctgatgtgctccaacaccatcttcacgctcaccgtggcgtggcggaccgccaccctgatcctggccgtgatcagcctcctgcccgtctgccagtccagctccatgcgcaagacggactggctgccgatgaccgtggccgccatgggggtgccgcccctccccctgttcatcttcagcctgaaggacaccctcaagcggcgctcctggccgctgaacgagggcgtcatggcggtggggctggtcagcatcctcgcctccagcttcctgcgcaacgacgtgcccatggccggccccctggtggccggcgggctcctgatcgcctgctacgtcatcaccggcacgtccgcggacctgaccgtggagaaggccgccgacgtgacctgggaggaggaggccgagcagaccggggtcagccacaacctcatgatcacggtggacgacgacggcaccatgcggatcaaggacgacgagaccgagaacatcctgaccgtgctgctcaagaccgccctgctgatcgtctccgggatcttcccctacagcatcccggcgacgctcctggtgtggcacacctggcagaagcagacccagcgctccggcgtgctgtgggacgtcccctccccgcccgagacccagaaggccgagctcgaggagggcgtgtaccggatcaagcagcaggggatcttcggcaagacccaggtgggggtcggcgtgcagaaggagggggtgttccacaccatgtggcacgtcacccgcggcgccgtgctgacccacaacggcaagcggctggagccgaactgggccaacgtgaagaaggacctcatctcctacgggggcgggtggaagctgagcgcgcagtggcagaagggcgaggaggtccaggtgatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtcgtgggcctgtacgggaacggcgtggtcaccaagaacgggggctacgtgagcgggatcgcccagaccaacgcggagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtcgtggccgcggagatggaggaggccctgaagggcctgcccatccgctaccagacgaccgccaccaagagcgagcacaccgggcgggagatcgtggacctcatgtgccacgccacgttcaccatgcgcctgctgtcccccgtccgggtgcccaactacaacctcatcgtgatggacgaggcccacttcaccgacccggcgagcatcgccgcccgcggctacatctccacccgggtcgggatgggcgaggccgcggccatcttcatgacggccacgccgcccggcaccgccgacgccttcccccagagcaacgcgccgatccaggacgaggagcgcgacatccccgagcggtcctggaacagcgggaacgagtggatcaccgacttcgccggcaagacggtgtggttcgtgccctccatcaaggccgggaacgacatcgccaactgcctgcgcaagaacggcaagaaggtcatccagctgagccgcaagaccttcgacaccgagtaccagaagaccaagctcaacgactgggacttcgtggtgacgaccgacatctccgagatgggggccaacttcaaggcggaccgggtcatcgacccccgccggtgcctgaagccggtgatcctgaccgacggccccgagcgcgtgatcctcgccggccccatgcccgtcaccgtggccagcgccgcccagcggcgcgggcgggtgggccgcaactcccagaaggagaacgaccagtacatcttcacggggcagccgctgaacaacgacgaggaccacgcgcactggaccgaggccaagatgctgctcgacaacatcaacacccccgagggcatcatccccgccctgttcgagcccgagcgggagaagtccgccgcgatcgacggggagtaccgcctgaagggcgagtcccggaagaccttcgtcgagctcatgcgccggggcgacctgccggtgtggctggcccacaaggtggccagcgaggggatcaagtacaccgaccgcaagtggtgcttcgacggcgagcggaacaaccagatcctcgaggagaacatggacgtcgagatctggacgaaggagggggagaagaagaagctgcgcccccggtggctggacgcccgcacctactccgaccccctcgccctgaaggagttcaaggacttcgcggccggccgcaagagcatcgccctggacctcgtgaccgagatcggccgcgtcccctcccacctggcccaccgcacccggaacgccctggacaacctcgtgatgctgcacacgagcgagcacgggggccgcgcgtaccggcacgccgtggaggagctgccggagaccatggagaccctcctgctgctcgggctgatgatcctgctcaccggcggggccatgctgttcctgatcagcggcaagggcatcgggaagacgtccatcggcctcatctgcgtcgtggccagctccgggatgctgtggatggccgacgtgcccctgcagtggatcgcgagcgccatcgtcctcgagttcttcatgatggtgctgctgatccccgagccggagaagcagcgcacgccccaggacaaccagctcgcctacgtggtcatcggcatcctgaccctggccgccatcgtggcggccaacgagatggggctcctggagaccacgaagcgggacctgggcatgtccaaggagcccggcgtggtcagccccacctcctacctcgacgtggacctgcacccggccagcgcctggaccctgtacgcggtggccaccacggtcatcacccccatgctccgccacaccatcgagaactccaccgccaacgtgagcctggccgccatcgcgaaccaggccgtggtcctgatggggctcgacaagggctggcccatctccaagatggacctgggggtgcccctgctcgccctgggctgctacagccaggtgaacccgctgacgctcaccgccgccgtcctgctgctcgtgacccactacgcgatcatcgggcccggcctgcaggccaaggccacccgggaggcccagaagcgcacggccgcgggcatcatgaagaaccccaccgtggacgggatcatgaccatcgacctggaccccgtcatctacgactccaagttcgagaagcagctcggccaggtgatgctgctggtgctctgcgccgtccagctgctgctcatgcggaccagctgggccttctgcgaggccctgacgctggcgaccgggccgatcaccaccctctgggagggctcccccggcaagttctggaacacgaccatcgccgtgagcatggccaacatcttccgcgggtcctacctggccggcgccgggctggcgttcagcatcatgaagtccgtgggcaccgggaagcggggcaccggcagccagggggagacgctcggcgagaagtggaagaagaagctgaaccagctgagccgcaaggagttcgacctctacaagaagtccgggatcaccgaggtcgaccggaccgaggccaaggagggcctgaagcgcggggagatcacccaccacgccgtgagccggggctccgccaagctgcagtggttcgtggagcgcaacatggtcatccccgagggccgggtgatcgacctcgggtgcggccgcgggggctggagctactactgcgccgggctgaagaaggtgaccgaggtccggggctacacgaagggcgggcccggccacgaggagccggtgcccatgtccacctacgggtggaacatcgtgaagctgatgagcggcaaggacgtcttctacctgccgcccgagaagtgcgacaccctgctgtgcgacatcggggagtccagcccgtcccccaccgtggaggagagccgcacgatccgggtgctgaagatggtcgagccctggctcaagaacaaccagttctgcatcaaggtgctgaacccctacatgccgaccgtgatcgagcacctggagcgcctccagcgcaagcacggcggcatgctggtccggaaccccctgtcccgcaacagcacccacgagatgtactggatctccaacgggaccggcaacatcgtgagctccgtgaacatggtcagccggctcctgctgaaccgcttcacgatgacccaccggcgccccaccatcgagaaggacgtggacctcggggcgggcacccggcacgtgaacgccgagcccgagacgccgaacatggacgtcatcggcgagcgcatccggcgcatcaaggaggagcactccagcacctggcactacgacgacgagaacccctacaagacctgggcctaccacgggtcctacgaggtgaaggccaccggcagcgccagctccatgatcaacggggtcgtgaagctgctgacgaagccctgggacgtggtcccgatggtgacccagatggcgatgaccgacaccacgcccttcggccagcagcgggtgttcaaggagaaggtcgacacccgcacgccccggcccatgccggggacccgcaaggtgatggagatcacggccgagtggctctggcggaccctgggccgcaacaagcggccccgcctgtgcacccgggaggagttcatcaagaaggtgcgcaccaacgccgccatgggcgcggtcttcacggaggagaaccagtgggacagcgcccgcgccgccgtggaggacgaggagttctggaagctcgtggaccgggagcgcgagctgcacaagctggggaagtgcggctcctgcgtctacaacatgatggggaagcgggagaagaagctcggcgagttcgggaaggccaagggcagccgcgcgatctggtacatgtggctgggcgcccggtacctggagttcgaggccctcgggttcctgaacgaggaccactggttctcccgcgagaacagccactccggcgtggagggggagggcctgcacaagctcgggtacatcctgcgggacatcagcaagatccccggcggcgccatgtacgccgacgacaccgcggggtgggacacccgcatcaccgaggacgacctgcacaacgaggagaagatcacgcagcagatggaccccgagcaccggcagctcgccaacgccatcttcaagctgacctaccagaacaaggtggtcaaggtgcagcgcccgacccccaagggcaccgtgatggacatcatctcccggaaggaccagcgcgggagcggccaggtcggcacgtacgggctgaacaccttcaccaacatggaggcccagctcatccggcagatggagggcgagggggtgctgtccaaggccgacctggagaacccccacctcctggagcgcaaggtgacccagtggctggagaccaagggcgtcgagcggctcaagcgcatggcgatcagcggggacgactgcgtggtgaagcccatcgacgaccggttcgccaacgccctgctggccctcaacgacatgggcaaggtccgcaaggacatcccgcagtggcagccctccaagggctggcacgactggcagcaggtccccttctgcagccaccacttccacgagctgatcatgaaggacgggcggaagctggtggtcccctgccgcccgcaggacgagctcatcggccgggcccgcatctcccagggggcgggctggagcctgcgcgagacggcctgcctggggaaggcctacgcccagatgtgggcgctcatgtacttccaccggcgcgacctgcggctggcctccaacgccatctgcagcgccgtgcccgtgcactgggtccccacctcccgcaccacctggagcatccacgcccaccaccagtggatgacgaccgaggacatgctcaccgtgtggaaccgggtgtggatcgaggacaacccctggatggaggacaagaccccggtcacgacctgggaggacgtgccctacctgggcaagcgcgaggaccagtggtgcggcagcctgatcgggctcacctcccgggcgacctgggcccagaacatcctgacggccatccagcaggtccgcagcctgatcggcaacgaggagttcctcgactacatgccctccatgaagcggttccgcaaggaggaggagagcgagggggccatctggtga

SEQ ID NO: 10359 - RNA, 9873 nt, synthetic construct
  misc_feature 1..9873: note = derived and/or modified CDS sequence (opt1) from DENV-3__JQ920482__SS-prME
  source 1..9873: mol_type = other RNA
accagcctctgcctcatgatgatgctgcccgccaccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagccgcccttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggccccaacacccccgagtgcccctccgcgagccgcgcctggaacgtgtgggaggtcgaggactacgggttcggcgtgttcacgaccaacatctggctgaagctgcgggagaagtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggatccggggcccctccctgcgcaccaccacggtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaagaccgacaacttcaccatgggcgtgctctgcctggcgatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcctccgaccgcatggggatgggcgtgacctacctggcgctcatcgccacgttcaagatccagcccttcctggccctggggttcttcctccggaagctgaccagccgcgagaacctgctcctgggcgtcggcctggccatggcgaccaccctccagctgcccgaggacatcgagcagatggccaacgggatcgccctgggcctcatggccctgaagctgatcacgcagttcgagacctaccagctctggaccgccctgatcagcctgatgtgctccaacaccatcttcacgctcaccgtggcgtggcggaccgccaccctgatcctggccgtgatcagcctcctgcccgtctgccagtccagctccatgcgcaagacggactggctgccgatgaccgtggccgccatgggggtgccgcccctccccctgttcatcttcagcctgaaggacaccctcaagcggcgctcctggccgctgaacgagggcgtcatggcggtggggctggtcagcatcctcgcctccagcttcctgcgcaacgacgtgcccatggccggccccctggtggccggcgggctcctgatcgcctgctacgtcatcaccggcacgtccgcggacctgaccgtggagaaggccgccgacgtgacctgggaggaggaggccgagcagaccggggtcagccacaacctcatgatcacggtggacgacgacggcaccatgcggatcaaggacgacgagaccgagaacatcctgaccgtgctgctcaagaccgccctgctgatcgtctccgggatcttcccctacagcatcccggcgacgctcctggtgtggcacacctggcagaagcagacccagcgctccggcgtgctgtgggacgtcccctccccgcccgagacccagaaggccgagctcgaggagggcgtgtaccggatcaagcagcaggggatcttcggcaagacccaggtgggggtcggcgtgcagaaggagggggtgttccacaccatgtggcacgtcacccgcggcgccgtgctgacccacaacggcaagcggctggagccgaactgggccaacgtgaagaaggacctcatctcctacgggggcgggtggaagctgagcgcgcagtggcagaagggcgaggaggtccaggtgatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtcgtgggcctgtacgggaacggcgtggtcaccaagaacgggggctacgtgagcgggatcgcccagaccaacgcggagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtcgtggccgcggagatggaggaggccctgaagggcctgcccatccgctaccagacgaccgccaccaagagcgagcacaccgggcgggagatcgtggacctcatgtgccacgccacgttcaccatgcgcctgctgtcccccgtccgggtgcccaactacaacctcatcgtgatggacgaggcccacttcaccgacccggcgagcatcgccgcccgcggctacatctccacccgggtcgggatgggcgaggccgcggccatcttcatgacggccacgccgcccggcaccgccgacgccttcccccagagcaacgcgccgatccaggacgaggagcgcgacatccccgagcggtcctggaacagcgggaacgagtggatcaccgacttcgccggcaagacggtgtggttcgtgccctccatcaaggccgggaacgacatcgccaactgcctgcgcaagaacggcaagaaggtcatccagctgagccgcaagaccttcgacaccgagtaccagaagaccaagctcaacgactgggacttcgtggtgacgaccgacatctccgagatgggggccaacttcaaggcggaccgggtcatcgacccccgccggtgcctgaagccggtgatcctgaccgacggccccgagcgcgtgatcctcgccggccccatgcccgtcaccgtggccagcgccgcccagcggcgcgggcgggtgggccgcaactcccagaaggagaacgaccagtacatcttcacggggcagccgctgaacaacgacgaggaccacgcgcactggaccgaggccaagatgctgctcgacaacatcaacacccccgagggcatcatccccgccctgttcgagcccgagcgggagaagtccgccgcgatcgacggggagtaccgcctgaagggcgagtcccggaagaccttcgtcgagctcatgcgccggggcgacctgccggtgtggctggcccacaaggtggccagcgaggggatcaagtacaccgaccgcaagtggtgcttcgacggcgagcggaacaaccagatcctcgaggagaacatggacgtcgagatctggacgaaggagggggagaagaagaagctgcgcccccggtggctggacgcccgcacctactccgaccccctcgccctgaaggagttcaaggacttcgcggccggccgcaagagcatcgccctggacctcgtgaccgagatcggccgcgtcccctcccacctggcccaccgcacccggaacgccctggacaacctcgtgatgctgcacacgagcgagcacgggggccgcgcgtaccggcacgccgtggaggagctgccggagaccatggagaccctcctgctgctcgggctgatgatcctgctcaccggcggggccatgctgttcctgatcagcggcaagggcatcgggaagacgtccatcggcctcatctgcgtcgtggccagctccgggatgctgtggatggccgacgtgcccctgcagtggatcgcgagcgccatcgtcctcgagttcttcatgatggtgctgctgatccccgagccggagaagcagcgcacgccccaggacaaccagctcgcctacgtggtcatcggcatcctgaccctggccgccatcgtggcggccaacgagatggggctcctggagaccacgaagcgggacctgggcatgtccaaggagcccggcgtggtcagccccacctcctacctcgacgtggacctgcacccggccagcgcctggaccctgtacgcggtggccaccacggtcatcacccccatgctccgccacaccatcgagaactccaccgccaacgtgagcctggccgccatcgcgaaccaggccgtggtcctgatggggctcgacaagggctggcccatctccaagatggacctgggggtgcccctgctcgccctgggctgctacagccaggtgaacccgctgacgctcaccgccgccgtcctgctgctcgtgacccactacgcgatcatcgggcccggcctgcaggccaaggccacccgggaggcccagaagcgcacggccgcgggcatcatgaagaaccccaccgtggacgggatcatgaccatcgacctggaccccgtcatctacgactccaagttcgagaagcagctcggccaggtgatgctgctggtgctctgcgccgtccagctgctgctcatgcggaccagctgggccttctgcgaggccctgacgctggcgaccgggccgatcaccaccctctgggagggctcccccggcaagttctggaacacgaccatcgccgtgagcatggccaacatcttccgcgggtcctacctggccggcgccgggctggcgttcagcatcatgaagtccgtgggcaccgggaagcggggcaccggcagccagggggagacgctcggcgagaagtggaagaagaagctgaaccagctgagccgcaaggagttcgacctctacaagaagtccgggatcaccgaggtcgaccggaccgaggccaaggagggcctgaagcgcggggagatcacccaccacgccgtgagccggggctccgccaagctgcagtggttcgtggagcgcaacatggtcatccccgagggccgggtgatcgacctcgggtgcggccgcgggggctggagctactactgcgccgggctgaagaaggtgaccgaggtccggggctacacgaagggcgggcccggccacgaggagccggtgcccatgtccacctacgggtggaacatcgtgaagctgatgagcggcaaggacgtcttctacctgccgcccgagaagtgcgacaccctgctgtgcgacatcggggagtccagcccgtcccccaccgtggaggagagccgcacgatccgggtgctgaagatggtcgagccctggctcaagaacaaccagttctgcatcaaggtgctgaacccctacatgccgaccgtgatcgagcacctggagcgcctccagcgcaagcacggcggcatgctggtccggaaccccctgtcccgcaacagcacccacgagatgtactggatctccaacgggaccggcaacatcgtgagctccgtgaacatggtcagccggctcctgctgaaccgcttcacgatgacccaccggcgccccaccatcgagaaggacgtggacctcggggcgggcacccggcacgtgaacgccgagcccgagacgccgaacatggacgtcatcggcgagcgcatccggcgcatcaaggaggagcactccagcacctggcactacgacgacgagaacccctacaagacctgggcctaccacgggtcctacgaggtgaaggccaccggcagcgccagctccatgatcaacggggtcgtgaagctgctgacgaagccctgggacgtggtcccgatggtgacccagatggcgatgaccgacaccacgcccttcggccagcagcgggtgttcaaggagaaggtcgacacccgcacgccccggcccatgccggggacccgcaaggtgatggagatcacggccgagtggctctggcggaccctgggccgcaacaagcggccccgcctgtgcacccgggaggagttcatcaagaaggtgcgcaccaacgccgccatgggcgcggtcttcacggaggagaaccagtgggacagcgcccgcgccgccgtggaggacgaggagttctggaagctcgtggaccgggagcgcgagctgcacaagctggggaagtgcggctcctgcgtctacaacatgatggggaagcgggagaagaagctcggcgagttcgggaaggccaagggcagccgcgcgatctggtacatgtggctgggcgcccggtacctggagttcgaggccctcgggttcctgaacgaggaccactggttctcccgcgagaacagccactccggcgtggagggggagggcctgcacaagctcgggtacatcctgcgggacatcagcaagatccccggcggcgccatgtacgccgacgacaccgcggggtgggacacccgcatcaccgaggacgacctgcacaacgaggagaagatcacgcagcagatggaccccgagcaccggcagctcgccaacgccatcttcaagctgacctaccagaacaaggtggtcaaggtgcagcgcccgacccccaagggcaccgtgatggacatcatctcccggaaggaccagcgcgggagcggccaggtcggcacgtacgggctgaacaccttcaccaacatggaggcccagctcatccggcagatggagggcgagggggtgctgtccaaggccgacctggagaacccccacctcctggagaagaaggtgacccagtggctggagaccaagggcgtcgagcgcctcaagcggatggcgatcagcggggacgactgcgtggtgaagcccatcgacgaccgcttcgccaacgccctgctggccctcaacgacatgggcaaggtccggaaggacatcccgcagtggcagccctccaagggctggcacgactggcagcaggtccccttctgcagccaccacttccacgagctgatcatgaaggacgggcgcaagctggtggtcccctgccggccgcaggacgagctcatcggccgcgcccggatctcccagggggcgggctggagcctgcgcgagacggcctgcctggggaaggcctacgcccagatgtgggcgctcatgtacttccaccgccgggacctgcgcctggcctccaacgccatctgcagcgccgtgcccgtgcactgggtccccacctcccggaccacctggagcatccacgcccaccaccagtggatgacgaccgaggacatgctcaccgtgtggaaccgcgtgtggatcgaggacaacccctggatggaggacaagaccccggtcacgacctgggaggacgtgccctacctgggcaagcgggaggaccagtggtgcggcagcctgatcgggctcacctcccgcgcgacctgggcccagaacatcctgacggccatccagcaggtccggagcctgatcggcaacgaggagttcctcgactacatgccctccatgaagcgcttccggaaggaggaggagagcgagggggccatctggtga

SEQ ID NO: 10360 - RNA, 9873 nt, synthetic construct
  misc_feature 1..9873: note = derived and/or modified CDS sequence (opt1) from DENV-3__JQ920484__SS-prME
  source 1..9873: mol_type = other RNA
accagcctctgcctcatgatgatgctgcccgccaccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagccgcccttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgccatcggcgtgctggagcagggcaagcggaccctgacgccccagcccatggagctcaagtacagctggaagacgtgggggaaggccaagatcgtcaccgcggagacccagaactccagcttcatcatcgacggccccaacacccccgagtgcccctccgccagccgcgcctggaacgtgtgggaggtggaggactacgggttcggcgtcttcacgaccaacatctggctgaagctgcgggagaagtacacccagctctgcgaccaccgcctgatgagcgccgccgtgaaggacgagcgggcggtgcacgccgacatgggctactggatcgagtcccagaagaacgggagctggaagctggagaaggcctccctcatcgaggtcaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtggtcatcaccgagaactgcgggatccggggcccctccctgcgcaccaccacggtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtctccgcgggcagcgggaagaccgacaacttcaccatgggcgtgctctgcctggccatcctgttcgaggaggtgatgcgcgggaagttcggcaagaagcacatgatcgccggggccctcttcacgttcgtcctgctgctctccggccagatcacctggcgggacatggcccacaccctgatcatgatcggcagcaacgcgtccgaccgcatggggatgggcgtgacctacctggccctcatcgccacgttcaagatccagcccttcctggccctggggttcttcctccggaagctgaccagccgcgagaacctgctcctgggcgtgggcctggcgatggccaccaccctccagctgcccgaggacatcgagcagatggccaacgggatcgccctgggcctcatggccctgaagctgatcacgcagttcgagacctaccagctctggaccgcgctgatcagcctgatgtgctccaacaccatcttcacgctcaccgtcgcctggcggaccgccaccctgatcctggccgtgatcagcctcctgcccgtgtgccagtccagctccatgcgcaagacggactggctgccgatgaccgtcgccgcgatgggggtgccgcccctccccctgttcatcttcagcctgaaggacaccctcaagcggcgctcctggccgctgaacgagggcgtgatggccgtcgggctggtgagcatcctcgcctccagcttcctgcgcaacgacgtccccatggccggccccctggtggccggcgggctcctgatcgcgtgctacgtgatcaccggcacgtccgccgacctgaccgtcgagaaggccgccgacgtgacctgggaggaggaggccgagcagaccggggtgagccacaacctcatgatcacggtcgacgacgacggcaccatgcggatcaaggacgacgagaccgagaacatcctgaccgtgctgctcaagaccgcgctgctgatcgtgtccgggatcttcccctacagcatcccggccacgctcctggtctggcacacctggcagaagcagacccagcgctccggcgtgctgtgggacgtgccctccccgcccgagacccagaaggccgagctcgaggagggcgtctaccggatcaagcagcaggggatcttcggcaagacccaggtgggggtgggcgtccagaaggagggggtgttccacaccatgtggcacgtgacccgcggcgccgtcctgacctacaacggcaagcggctggagccgaactgggcgaacgtgaagaaggacctcatctcctacgggggcgggtggaagctgagcgcccagtggcagaagggcgaggaggtgcaggtcatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtggtcggcctgtacgggaacggcgtggtgaccaagaacgggggctacgtcagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtggtcgcggccgagatggaggaggccctgaagggcctgcccatccgctaccagacgaccgccaccaagagcgagcacaccgggcgggagatcgtggacctcatgtgccacgccacgttcaccatgcgcctgctgtcccccgtgcgggtccccaactacaacctcatcgtgatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtctggttcgtgccctccatcaaggccgggaacgacatcgccaactgcctgcgcaagaacggcaagaaggtgatccagctgagccgcaagaccttcgacaccgagtaccagaagaccaagctcaacgactgggacttcgtcgtgacgaccgacatctccgagatgggggcgaacttcaaggccgaccgggtgatcgacccccgccggtgcctgaagccggtcatcctgaccgacggccccgagcgcgtgatcctcgccggccccatgcccgtgaccgtcgccagcgccgcgcagcggcgcgggcgggtgggccgcaactcccagaaggagaacgaccagtacatcttcacggggcagccgctgaacaacgacgaggaccacgcccactggaccgaggccaagatgctgctcgacaacatcaacacccccgagggcatcatccccgccctgttcgagcccgagcgggagaagtccgcggccatcgacggggagtaccgcctgaagggcgagtcccggaagaccttcgtggagctcatgcgccggggcgacctgccggtctggctggcccacaaggtggccagcgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctactccgaccccctcgcgctgaaggagttcaaggacttcgccgccggccgcaagagcatcgccctggacctcgtcaccgagatcggccgcgtgccctcccacctggcccaccgcacccggaacgcgctggacaacctcgtcatgctgcacacgagcgagcacgggggccgcgcctaccggcacgccgtggaggagctgccggagaccatggagaccctcctgctgctcgggctgatgatcctgctcaccggcggggccatgctgttcctgatcagcggcaagggcatcgggaagacgtccatcggcctcatctgcgtggtcgccagctccgggatgctgtggatggcggacgtgcccctgcagtggatcgccagcgccatcgtgctcgagttcttcatgatggtcctgctgatccccgagccggagaagcagcgcacgccccaggacaaccagctcgcctacgtggtgatcggcatcctgaccctggccgcgatcgtcgccgccaacgagatggggctcctggagaccacgaagcgggacctgggcatgtccaaggagcccggcgtggtgagccccacctcctacctcgacgtcgacctgcacccggccagcgcgtggaccctgtacgccgtggccaccacggtgatcacccccatgctccgccacaccatcgagaactccaccgccaacgtcagcctggccgcgatcgccaaccaggccgtggtgctgatggggctcgacaagggctggcccatctccaagatggacctgggggtccccctgctcgccctgggctgctacagccaggtgaacccgctgacgctcaccgccgcggtgctgctgctcgtcacccactacgccatcatcgggcccggcctgcaggccaaggccacccgggaggcccagaagcgcacggcggccggcatcatgaagaaccccaccgtggacgggatcatgaccatcgacctggaccccgtgatctacgactccaagttcgagaagcagctcggccaggtcatgctgctggtgctctgcgccgtgcagctgctgctcatgcggaccagctgggccttctgcgaggcgctgacgctggccaccgggccgatcaccaccctctgggagggctcccccggcaagttctggaacacgaccatcgccgtcagcatggccaacatcttccgcgggtcctacctggccggcgcggggctggccttcagcatcatgaagtccgtgggcaccgggaagcggggcaccggcagccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtcagccggggctccgccaagctgcagtggttcgtggagcgcaacatggtgatccccgagggccgggtcatcgacctcgggtgcggccgcgggggctggagctactactgcgcggggctgaagaaggtgaccgaggtgcggggctacacgaagggcgggcccggccacgaggagccggtccccatgtccacctacgggtggaacatcgtgaagctgatgagcggcaaggacgtgttctacctgccgcccgagaagtgcgacaccctgctgtgcgacatcggggagtccagcccgtcccccaccgtcgaggagagccgcacgatccgggtgctgaagatggtggagccctggctcaagaacaaccagttctgcatcaaggtcctgaacccctacatgccgaccgtgatcgagcacctggagcgcctccagcgcaagcacggcggcatgctggtgcggaaccccctgtcccgcaacagcacccacgagatgtactggatctccaacgggaccggcaacatcgtcagctccgtgaacatggtgagccggctcctgctgaaccgcttcacgatgacccaccggcgccccaccatcgagaaggacgtcgacctcggggccggcacccggcacgtgaacgccgagcccgagacgccgaacatggacgtgatcggcgagcgcatccggcgcatcaaggaggagcactccagcacctggcactacgacgacgagaacccctacaagacctgggcctaccacgggtcctacgaggtcaaggccaccggcagcgcgagctccatgatcaacggggtggtcaagctgctgacgaagccctgggacgtggtgccgatggtcacccagatggccatgaccgacaccacgcccttcggccagcagcgggtgttcaaggagaaggtggacacccgcacgccccggcccatgccggggacccgcaaggtcatggagatcacggccgagtggctctggcggaccctgggccgcaacaagcggccccgcctgtgcacccgggaggagttcatcaagaaggtgcgcaccaacgccgcgatgggcgccgtgttcacggaggagaaccagtgggacagcgcccgcgccgccgtcgaggacgaggagttctggaagctcgtggaccgggagcgcgagctgcacaagctggggaagtgcggctcctgcgtgtacaacatgatggggaagcgggagaagaagctcggcgagttcgggaaggcgaagggcagccgcgccatctggtacatgtggctgggcgcccggtacctggagttcgaggccctcgggttcctgaacgaggaccactggttctcccgcgagaacagccactccggcgtcgagggggagggcctgcacaagctcgggtacatcctgcgggacatcagcaagatccccggcggcgccatgtacgcggacgacaccgccgggtgggacacccgcatcaccgaggacgacctgcacaacgaggagaagatcacgcagcagatggaccccgagcaccggcagctcgccaacgccatcttcaagctgacctaccagaacaaggtggtgaaggtccagcgcccgacccccaagggcaccgtgatggacatcatctcccggaaggaccagcgcgggagcggccaggtgggcacgtacgggctgaacaccttcaccaacatggaggcccagctcatccggcagatggagggcgagggggtcctgtccaaggcggacctggagaacccccacctcctggagaagaaggtgacccagtggctggagaccaagggcgtggagcgcctcaagcggatggccatcagcggggacgactgcgtcgtgaagcccatcgacgaccgcttcgccaacgccctgctggccctcaacgacatgggcaaggtgcggaaggacatcccgcagtggcagccctccaagggctggcacgactggcagcaggtccccttctgcagccaccacttccacgagctgatcatgaaggacgggcgcaagctggtggtgccctgccggccgcaggacgagctcatcggccgcgcgcggatctcccagggggccggctggagcctgcgcgagacggcctgcctggggaaggcctacgcgcagatgtgggccctcatgtacttccaccgccgggacctgcgcctggcctccaacgccatctgcagcgccgtccccgtgcactgggtgcccacctcccggaccacctggagcatccacgcgcaccaccagtggatgacgaccgaggacatgctcaccgtctggaaccgcgtgtggatcgaggacaacccctggatggaggacaagaccccggtgacgacctgggaggacgtcccctacctgggcaagcgggaggaccagtggtgcggcagcctgatcgggctcacctcccgcgccacctgggcccagaacatcctgacggccatccagcaggtccggagcctgatcggcaacgaggagttcctcgactacatgccctccatgaagcgcttccggaaggaggaggagagcgagggggccatctggtga

SEQ ID NO: 10361 - RNA, 9873 nt, synthetic construct
  misc_feature 1..9873: note = derived and/or modified CDS sequence (opt1) from DENV-3__JQ920486__SS-prME
  source 1..9873: mol_type = other RNA
accagcctctgcctcatgatgatgctgcccgccaccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagccgcccttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgccatcggcgtgctggagcagggcaagcggaccctgacgccccagcccatggagctcaagtacagctggaagacgtgggggaaggccaagatcgtcaccgcggagacccagaactccagcttcatcatcgacggccccaacacccccgagtgcccctccgccagccgcgcctggaacgtgtgggaggtggaggactacgggttcggcgtcttcacgaccaacatctggctgaagctgcgggagaagtacacccagctctgcgaccaccgcctgatgagcgccgccgtgaaggacgagcgggcggtgcacgtcgacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggatccggggcccctccctgcgcaccaccacggtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaagaccgacaacttcaccatgggcgtgctctgcctggcgatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcctccgaccgcatggggatgggcgtgacctacctggcgctcatcgccacgttcaagatccagcccttcctggccctggggttcttcctccggaagctgaccagccgcgagaacctgctcctgggcgtcggcctggccatggcgaccaccctccagctgcccgaggacatcgagcagatggccaacgggatcgccctgggcctcatggccctgaagctgatcacgcagttcgagacctaccagctctggaccgccctgatcagcctgatgtgctccaacaccatcttcacgctcaccgtggcgtggcggaccgccaccctgatcctggccgtgatcagcctcctgcccgtctgccagtccagctccatgcgcaagacggactggctgccgatgaccgtggccgccatgggggtgccgcccctccccctgttcatcttcagcctgaaggacaccctcaagcggcgctcctggccgctgaacgagggcgtcatggcggtggggctggtcagcatcctcgcctccagcttcctgcgcaacgacgtgcccatggccggccccctggtggccggcgggctcctgatcgcctgctacgtcatcaccggcacgtccgcggacctgaccgtggagaaggccgccgacgtgacctgggaggaggaggccgagcagaccggggtcagccacaacctcatgatcacggtggacgacgacggcaccatgcggatcaaggacgacgagaccgagaacatcctgaccgtgctgctcaagaccgccctgctgatcgtctccgggatcttcccctacagcatcccggcgacgctcctggtgtggcacacctggcagaagcagacccagcgctccggcgtgctgtgggacgtcccctccccgcccgagacccagaaggccgagctcgaggagggcgtgtaccggatcaagcagcaggggatcttcggcaagacccaggtgggggtcggcgtgcagaaggagggggtgttccacaccatgtggcacgtcacccgcggcgccgtgctgacccacaacggcaagcggctggagccgaactgggccaacgtgaagaaggacctcatctcctacgggggcgggtggaagctgagcgcgcagtggcagaagggcgaggaggtccaggtgatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtcgtgggcctgtacgggaacggcgtggtcaccaagaacgggggctacgtgagcgggatcgcccagaccaacgcggagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtcgtggccgcggagatggaggaggccctgaagggcctgcccatccgctaccagacgaccgccaccaagagcgagcacaccgggcgggagatcgtggacctcatgtgccacgccacgttcaccatgcgcctgctgtcccccgtccgggtgcccaactacaacctcatcgtgatggacgaggcccacttcaccgacccggcgagcatcgccgcccgcggctacatctccacccgggtcgggatgggcgaggccgcggccatcttcatgacggccacgccgcccggcaccgccgacgccttcccccagagcaacgcgccgatccaggacgaggagcgcgacatccccgagcggtcctggaacagcgggaacgagtggatcaccgacttcgccggcaagacggtgtggttcgtgccctccatcaaggccgggaacgacatcgccaactgcctgcgcaagaacggcaagaaggtcatccagctgagccgcaagaccttcgacaccgagtaccagaagaccaagctcaacgactgggacttcgtggtgacgaccgacatctccgagatgggggccaacttcaaggcggaccgggtcatcgacccccgccggtgcctgaagccggtgatcctgaccgacggccccgagcgcgtgatcctcgccggccccatgcccgtcaccgtggccagcgccgcccagcggcgcgggcgggtgggccgcaactcccagaaggagaacgaccagtacatcttcacggggcagccgctgaacaacgacgaggaccacgcgcactggaccgaggccaagatgctgctcgacaacatcaacacccccgagggcatcatccccgccctgttcgagcccgagcgggagaagtccgccgcgatcgacggggagtaccgcctgaagggcgagtcccggaagaccttcgtcgagctcatgcgccggggcgacctgccggtgtggctggcccacaaggtggccagcgaggggatcaagtacaccgaccgcaagtggtgcttcgacggcgagcggaacaaccagatcctcgaggagaacatggacgtcgagatctggacgaaggagggggagaagaagaagctgcgcccccggtggctggacgcccgcacctactccgaccccctcgccctgaaggagttcaaggacttcgcggccggccgcaagagcatcgccctggacctcgtgaccgagatcggccgcgtcccctcccacctggcccaccgcacccggaacgccctggacaacctcgtgatgctgcacacgagcgagcacgggggccgcgcgtaccggcacgccgtggaggagctgccggagaccatggagaccctcctgctgctcgggctgatgatcctgctcaccggcggggccatgctgttcctgatcagcggcaagggcatcgggaagacgtccatcggcctcatctgcgtcgtggccagctccgggatgctgtggatggccgacgtgcccctgcagtggatcgcgagcgccatcgtcctcgagttcttcatgatggtgctgctgatccccgagccggagaagcagcgcacgccccaggacaaccagctcgcctacgtggtcatcggcatcctgaccctggccgccatcgtggcggccaacgagatggggctcctggagaccacgaagcgggacctgggcatgtccaaggagcccggcgtggtcagccccacctcctacctcgacgtggacctgcacccggccagcgcctggaccctgtacgcggtggccaccacggtcatcacccccatgctccgccacaccatcgagaactccaccgccaacgtgagcctggccgccatcgcgaaccaggccgtggtcctgatggggctcgacaagggctggcccatctccaagatggacctgggggtgcccctgctcgccctgggctgctacagccaggtgaacccgctgacgctcaccgccgccgtcctgctgctcgtgacccactacgcgatcatcgggcccggcctgcaggccaaggccacccgggaggcccagaagcgcacggccgcgggcatcatgaagaaccccaccgtggacgggatcatgaccatcgacctggaccccgtcatctacgactccaagttcgagaagcagctcggccaggtgatgctgctggtgctctgcgccgtccagctgctgctcatgcggaccagctgggccttctgcgaggccctgacgctggcgaccgggccgatcaccaccctctgggagggctcccccggcaagttctggaacacgaccatcgccgtgagcatggccaacatcttccgcgggtcctacctggccggcgccgggctggcgttcagcatcatgaagtccgtgggcaccgggaagcggggcaccggcagccagggggagacgctcggcgagaagtggaagaagaagctgaaccagctgagccgcaaggagttcgacctctacaagaagtccgggatcaccgaggtcgaccggatcgaggccaaggagggcctgaagcgcggggagatcacccaccacgccgtgagccggggctccgccaagctgcagtggttcgtggagcgcaacatggtcatccccgagggccgggtgatcgacctcgggtgcggccgcgggggctggagctactactgcgccgggctgaagaaggtgaccgaggtccggggctacaccaagggcgggcccggccacgaggagccggtgcccatgtccacgtacgggtggaacatcgtgaagctgatgagcggcaaggacgtcttctacctgccgcccgagaagtgcgacaccctgctgtgcgacatcggggagtccagcccgtcccccaccgtggaggagagccgcaccatccgggtgctgaagatggtcgagccctggctcaagaacaaccagttctgcatcaaggtgctgaacccctacatgccgacggtgatcgagcacctggagcgcctccagcgcaagcacggcggcatgctggtccggaaccccctgtcccgcaacagcacccacgagatgtactggatctccaacgggaccggcaacatcgtgagctccgtgaacatggtcagccggctcctgctgaaccgcttcaccatgacgcaccggcgccccaccatcgagaaggacgtggacctcggggcgggcacccggcacgtgaacgccgagcccgagaccccgaacatggacgtcatcggcgagcgcatccggcgcatcaaggaggagcactccagcacgtggcactacgacgacgagaacccctacaagacctgggcctaccacgggtcctacgaggtgaaggccaccggcagcgccagctccatgatcaacggggtcgtgaagctgctgaccaagccctgggacgtggtcccgatggtgacgcagatggcgatgaccgacaccacccccttcggccagcagcgggtgttcaaggagaaggtcgacacgcgcacgccccggcccatgccggggacccgcaaggtgatggagatcaccgccgagtggctctggcggacgctgggccgcaacaagcggccccgcctgtgcacccgggaggagttcatcaagaaggtgcgcaccaacgccgccatgggcgcggtcttcaccgaggagaaccagtgggacagcgcccgcgccgccgtggaggacgaggagttctggaagctcgtggaccgggagcgcgagctgcacaagctggggaagtgcggctcctgcgtctacaacatgatggggaagcgggagaagaagctcggcgagttcgggaaggccaagggcagccgcgcgatctggtacatgtggctgggcgcccggtacctggagttcgaggccctcgggttcctgaacgaggaccactggttctcccgcgagaacagccactccggcgtggagggggagggcctgcacaagctcgggtacatcctgcgggacatcagcaagatccccggcggcgccatgtacgccgacgacacggcggggtgggacacccgcatcaccgaggacgacctgcacaacgaggagaagatcacccagcagatggaccccgagcaccggcagctcgccaacgccatcttcaagctgacgtaccagaacaaggtggtcaaggtgcagcgcccgacccccaagggcaccgtgatggacatcatctcccggaaggaccagcgcgggagcggccaggtcggcacctacgggctgaacacgttcaccaacatggaggcccagctcatccggcagatggagggcgagggggtgctgtccaaggccgacctggagaacccccacctcctggagaagaaggtgacccagtggctggagaccaagggcgtcgagcgcctcaagcggatggcgatcagcggggacgactgcgtggtgaagcccatcgacgaccgcttcgccaacgccctgctggccctcaacgacatgggcaaggtccggaaggacatcccgcagtggcagccctccaagggctggcacgactggcagcaggtccccttctgcagccaccacttccacgagctgatcatgaaggacgggcgcaagctggtggtcccctgccggccgcaggacgagctcatcggccgcgcccggatctcccagggggcgggctggagcctgcgcgagaccgcctgcctggggaaggcctacgcccagatgtgggcgctcatgtacttccaccgccgggacctgcgcctggcctccaacgccatctgcagcgccgtgcccgtgcactgggtccccacgtcccggaccacctggagcatccacgcccaccaccagtggatgaccacggaggacatgctcaccgtgtggaaccgcgtgtggatcgaggacaacccctggatggaggacaagaccccggtcaccacgtgggaggacgtgccctacctgggcaagcgggaggaccagtggtgcggcagcctgatcgggctcacctcccgcgcgacctgggcccagaacatcctgaccgccatccagcaggtccggagcctgatcggcaacgaggagttcctcgactacatgccctccatgaagcgcttccggaaggaggaggagagcgagggggccatctggtga

SEQ ID NO: 10362 - RNA, 9873 nt, synthetic construct
  misc_feature 1..9873: note = derived and/or modified CDS sequence (opt1) from DENV-3__JQ920485__SS-prME
  source 1..9873: mol_type = other RNA
accagcctctgcctcatgatgatgctgcccgccaccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacgtacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcacccagacgtggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcgatcctgcccgaggagcaggaccagaactacgtgtgcaagcacacctacgtcgaccgggggtggggcaacgggtgcggcctcttcgggaagggctccctggtgacctgcgccaagttccagtgcctggagagcatcgagggcaaggccgtgcagcacgagaacctcaagtacacggtcatcatcaccgtgcacaccggggaccagcaccaggtgggcaacgagacccagggggtcacggccgagatcacgccccaggcctccaccgtggaggcgatcctgcccgagtacggcaccctggggctcgagtgcagcccccgcaccggcctggacttcaacgagatgatcctgctcacgatgaagaacaaggcctggatggtccaccggcagtggttcttcgacctgccgctgccctggacctccggcgccaccaccgagacgcccacctggaacaagaaggagctcctggtgaccttcaagaacgcccacgccaagaagcaggaggtggtcgtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtgctcaagaaggaggtcagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtgacgaagaaggaggagcccgtcaacatcgaggcggagccgcccttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtgggcggggtcctgaactccctgggcaagatggtgcaccagatcttcgggagcgcctacaccgccctcttctccggcgtgagctggatcatgaagatcggcatcggggtcctgctgacgtggatcggcctcaactccaagaacaccagcatgtccttcagctgcatcgtgatcgggatcatcaccctgtacctgggcgccgtggtccaggcggacatggggtgcgtgatcaactggaagggcaaggagctcaagtgcggctccgggatcttcgtgaccaacgaggtccacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtggtcggggacgtgatcggcgtgctggagcagggcaagcggaccctgacgccccagcccatggagctcaagtacagctggaagacgtgggggaaggccaagatcgtcaccgccgagacccagaactccagcttcatcatcgacggccccaacacccccgagtgcccctccgcgagccgcgcctggaacgtgtgggaggtggaggactacgggttcggcgtcttcacgaccaacatctggctgaagctgcgggagaagcacacccagctctgcgaccaccgcctgatgagcgccgccgtgaaggacgagcgggccgtgcacgcggacatgggctactggatcgagtcccagaagaacgggagctggaagctggagaaggcctccctcatcgaggtcaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtggtcatcaccgagaactgcgggatccggggcccctccctgcgcaccaccacggtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtctccgccggcagcgggaagaccgacaacttcaccatgggcgtgctctgcctggcgatcctgttcgaggaggtgatgcgcgggaagttcggcaagaagcacatgatcgccggggccctcttcacgttcgtcctgctgctctccggccagatcacctggcgggacatggcccacaccctgatcatgatcggcagcaacgcctccgaccgcatggggatgggcgtgacctacctggcgctcatcgccacgttcaagatccagcccttcctggccctggggttcttcctccggaagctgaccagccgcgagaacctgctcctgggcgtgggcctggccatggcgaccaccctccagctgcccgaggacatcgagcagatggccaacgggatcgccctgggcctcatggccctgaagctgatcacgcagttcgagacctaccagctctggaccgccctgatcagcctgatgtgctccaacaccatcttcacgctcaccgtcgcgtggcggaccgccaccctgatcctggccgtgatcagcctcctgcccgtgtgccagtccagctccatgcgcaagacggactggctgccgatgaccgtcgccgccatgggggtgccgcccctccccctgttcatcttcagcctgaaggacaccctcaagcggcgctcctggccgctgaacgagggcgtgatggcggtcgggctggtgagcatcctcgcctccagcttcctgcgcaacgacgtccccatggccggccccctggtggccggcgggctcctgatcgcctgctacgtgatcaccggcacgtccgcggacctgaccgtcgagaaggccgccgacgtgacctgggaggaggaggccgagcagaccggggtgagccacaacctcatgatcacggtcgacgacgacggcaccatgcggatcaaggacgacgagaccgagaacatcctgaccgtgctgctcaagaccgccctgctgatcgtgtccgggatcttcccctacagcatcccggcgacgctcctggtctggcacacctggcagaagcagacccagcgctccggcgtgctgtgggacgtgccctccccgcccgagacccagaaggccgagctcgaggagggcgtctaccggatcaagcagcaggggatcttcggcaagacccaggtgggggtgggcgtccagaaggagggggtgttccacaccatgtggcacgtgacccgcggcgccgtcctgacccacaacggcaagcggctggagccgaactgggccaacgtgaagaaggacctcatctcctacgggggcgggtggaagctgagcgcgcagtggcagaagggcgaggaggtgcaggtcatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtggtcggcctgtacgggaacggcgtggtgaccaagaacgggggctacgtcagcgggatcgcccagaccaacgcggagcccgacggcccgatccccgagctcgaggaggagatgttcaagaagcggaacctgaccatcatggacctgcaccccggctccgggaagacgcgcaagtacctccccgccatcgtgcgggaggccatcaagcgccggctgcgcaccctgatcctcgccccgacccgggtggtcgccgcggagatggaggaggccctgaagggcctgcccatccgctaccagaccacggccaccaagagcgagcacaccgggcgggagatcgtggacctcatgtgccacgccaccttcacgatgcgcctgctgtcccccgtgcgggtccccaactacaacctcatcgtgatggacgaggcccacttcaccgacccggcgagcatcgccgcccgcggctacatctccacccgggtggggatgggcgaggccgcggccatcttcatgaccgccacgccgcccggcaccgccgacgccttcccccagagcaacgcgccgatccaggacgaggagcgcgacatccccgagcggtcctggaacagcgggaacgagtggatcaccgacttcgccggcaagaccgtctggttcgtgccctccatcaaggccgggaacgacatcgccaactgcctgcgcaagaacggcaagaaggtgatccagctgagccgcaagacgttcgacaccgagtaccagaagaccaagctcaacgactgggacttcgtcgtgaccacggacatctccgagatgggggccaacttcaaggcggaccgggtgatcgacccccgccggtgcctgaagccggtcatcctgaccgacggccccgagcgcgtgatcctcgccggccccatgcccgtgaccgtcgccagcgccgcccagcggcgcgggcgggtgggccgcaactcccagaaggagaacgaccagtacatcttcaccgggcagccgctgaacaacgacgaggaccacgcgcactggacggaggccaagatgctgctcgacaacatcaacacccccgagggcatcatccccgccctgttcgagcccgagcgggagaagtccgccgcgatcgacggggagtaccgcctgaagggcgagtcccggaagaccttcgtggagctcatgcgccggggcgacctgccggtctggctggcccacaaggtggccagcgaggggatcaagtacaccgaccgcaagtggtgcttcgacggcgagcggaacaaccagatcctcgaggagaacatggacgtggagatctggaccaaggagggggagaagaagaagctgcgcccccggtggctggacgcccgcacgtactccgaccccctcgccctgaaggagttcaaggacttcgcggccggccgcaagagcatcgccctggacctcgtcaccgagatcggccgcgtgccctcccacctggcccaccgcacccggaacgccctggacaacctcgtcatgctgcacaccagcgagcacgggggccgcgcgtaccggcacgccgtggaggagctgccggagacgatggagaccctcctgctgctcgggctgatgatcctgctcaccggcggggccatgctgttcctgatcagcggcaagggcatcgggaagacctccatcggcctcatctgcgtggtcgccagctccgggatgctgtggatggccgacgtgcccctgcagtggatcgcgagcgccatcgtgctcgagttcttcatgatggtcctgctgatccccgagccggagaagcagcgcacgccccaggacaaccagctcgcctacgtggtgatcggcatcctgaccctggccgccatcgtcgcggccaacgagatggggctcctggagaccaccaagcgggacctgggcatgtccaaggagcccggcgtggtgagccccacgtcctacctcgacgtcgacctgcacccggccagcgcctggaccctgtacgcggtggccaccaccgtgatcacgcccatgctccgccacaccatcgagaactccaccgccaacgtcagcctggccgccatcgcgaaccaggccgtggtgctgatggggctcgacaagggctggcccatctccaagatggacctgggggtccccctgctcgccctgggctgctacagccaggtgaacccgctgaccctcacggccgccgtgctgctgctcgtcacccactacgcgatcatcgggcccggcctgcaggccaaggccacccgggaggcccagaagcgcaccgccgcgggcatcatgaagaaccccacggtggacgggatcatgaccatcgacctggaccccgtgatctacgactccaagttcgagaagcagctcggccaggtcatgctgctggtgctctgcgccgtgcagctgctgctcatgcggaccagctgggccttctgcgaggccctgaccctggcgacggggccgatcaccaccctctgggagggctcccccggcaagttctggaacaccacgatcgccgtcagcatggccaacatcttccgcgggtcctacctggccggcgccgggctggcgttcagcatcatgaagtccgtgggcaccgggaagcggggcaccggcagccagggggagaccctcggcgagaagtggaagaagaagctgaaccagctgagccgcaaggagttcgacctctacaagaagtccgggatcacggaggtggaccggatcgaggccaaggagggcctgaagcgcggggagatcacccaccacgccgtcagccggggctccgccaagctgcagtggttcgtggagcgcaacatggtgatccccgagggccgggtcatcgacctcgggtgcggccgcgggggctggagctactactgcgccgggctgaagaaggtgaccgaggtgcggggctacaccaagggcgggcccggccacgaggagccggtccccatgtccacctacgggtggaacatcgtgaagctgatgagcggcaaggacgtgttctacctgccgcccgagaagtgcgacacgctgctgtgcgacatcggggagtccagcccgtcccccaccgtcgaggagagccgcaccatccgggtgctgaagatggtggagccctggctcaagaacaaccagttctgcatcaaggtcctgaacccctacatgccgaccgtgatcgagcacctggagcgcctccagcgcaagcacggcggcatgctggtgcggaaccccctgtcccgcaacagcacgcacgagatgtactggatctccaacgggaccggcaacatcgtcagctccgtgaacatggtgagccggctcctgctgaaccgcttcaccatgacccaccggcgccccacgatcgagaaggacgtcgacctcggggcgggcacccggcacgtgaacgccgagcccgagaccccgaacatgaacgtgatcggcgagcgcatccggcgcatcaaggaggagcactccagcacctggcactacgacgacgagaacccctacaagacgtgggcctaccacgggtcctacgaggtcaaggccaccggcagcgccagctccatgatcaacggggtggtcaagctgctgaccaagccctgggacgtggtgccgatggtcacccagatggcgatgacggacaccacccccttcggccagcagcgggtgttcaaggagaaggtggacacccgcacgccccggcccatgccggggacccgcaaggtcatggagatcaccgccgagtggctctggcggaccctgggccgcaacaagcggccccgcctgtgcacgcgggaggagttcatcaagaaggtgcgcaccaacgccgccatgggcgcggtgttcaccgaggagaaccagtgggacagcgcccgcgccgccgtcgaggacgaggagttctggaagctcgtggaccgggagcgcgagctgcacaagctggggaagtgcggctcctgcgtgtacaacatgatggggaagcgggagaagaagctcggcgagttcgggaaggccaagggcagccgcgcgatctggtacatgtggctgggcgcccggtacctggagttcgaggccctcgggttcctgaacgaggaccactggttctcccgcgagaacagccactccggcgtcgagggggagggcctgcacaagctcgggtacatcctgcgggacatcagcaagatccccggcggcgccatgtacgccgacgacaccgcggggtgggacacgcgcatcaccgaggacgacctgcacaacgaggagaagatcacccagcagatggaccccgagcaccggcagctcgccaacgccatcttcaagctgacctaccagaacaaggtggtgaaggtccagcgcccgacgcccaagggcaccgtgatggacatcatctcccggaaggaccagcgcgggagcggccaggtgggcacctacgggctgaacaccttcacgaacatggaggcccagctcatccggcagatggagggcgagggggtcctgtccaaggccgacctggagaacccccacctcctggagaagaaggtgacccagtggctggagaccaagggcgtggagcgcctcaagcggatggcgatcagcggggacgactgcgtcgtgaagcccatcgacgaccgcttcgccaacgccctgctggccctcaacgacatgggcaaggtgcggaaggacatcccgcagtggcagccctccaagggctggcacgactggcagcaggtccccttctgcagccaccacttccacgagctgatcatgaaggacgggcgcaagctggtggtgccctgccggccgcaggacgagctcatcggccgcgcccggatctcccagggggcgggctggagcctgcgcgagaccgcctgcctggggaaggcctacgcccagatgtgggcgctcatgtacttccaccgccgggacctgcgcctggcctccaacgccatctgcagcgccgtccccgtgcactgggtgcccacctcccggacgacctggagcatccacgcccaccaccagtggatgaccaccgaggacatgctcacggtctggaaccgcgtgtggatcgaggacaacccctggatggaggacaagaccccggtgaccacctgggaggacgtcccctacctgggcaagcgggaggaccagtggtgcggcagcctgatcgggctcacgtcccgcgcgacctgggcccagaacatcctgaccgccatccagcaggtccggagcctgatcggcaacgaggagttcctcgactacatgccctccatgaagcgcttccggaaggaggaggagcccgagggggccatctggtga

SEQ ID NO: 10363 - RNA, 9873 nt, synthetic construct
  misc_feature 1..9873: note = derived and/or modified CDS sequence (opt1) from DENV-3__FJ644564__SS-prME
  source 1..9873: mol_type = other RNA
accagcctgtgcctcatgatgatcctgcccgccgccctggcgttccacctcaccagccgcgacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgccatcgccggcgcgtgggagaacggggtctgcggcatccgcagcacgacccggatggagaacctgctgtggaagcagatcgccaacgagctcaactacatcctgtgggagaacaacatcaagctgaccgtggtggtcggggacaccatcggcgtgctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtctgggaggtggaggactacgggttcggcgtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacgtgcacctggccgaagtcccacaccctgtggagcaacggcgtgctcgagtccgacatgatcatccccaagagcctggccgggcccatctcccagcacaaccaccggccgggctaccacacccagacggccgggccctggcacctggagaacctcgagctggacttcacctactgcgagggcaccaccgtggtcatcacggagaactgcggcacccgcgggcccagcctgcggaccaccacggtgtccggcaagctcatccacgagtggtgctgccgcagctgcaccctgcccccgctgcggtacatgggggaggacggctgctggtacgggatggagatccgccccatctccgagaaggaggagaacatggtcaagagcctcgtctccgccggcagcggcaaggtggacaacttcaccatggggatcctgtgcctggcgatcctcttcgaggaggtgatgcggggcaagttcgggaagaagcacatgatcgccggcgtcttcttcaccttcgtgctgctgctctccgggcagatcacgtggcgcgacatggcccacaccctgatcatgatcggcagcaacgcctccgaccggatgggcatgggggtgacctacctggccctcatcgcgaccttcaagatccagcccttcctggccctgggcttcttcctccgcaagctgacgagccgggagaacctgctcctgggggtcggcctggccatggccaccaccctccagctgcccgaggacatcgagcagatggcgaacggcatcgccctggggctcatggccctgaagctgatcacccagttcgagacgtaccagctctggaccgccctgatcagcctgacctgctccaacaccatcttcacgctcaccgtggcctggcgcaccgcgaccctgatcctggccggcgtgagcctcctgccggtctgccagtccagctccatgcggaagacggactggctgcccatgaccgtggccgccatgggggtgccgcccctcccgctgttcatcttcagcctgaaggacaccctcaagcgccgctcctggcccctgaacgagggcgtgatggccgtggggctggtcagcatcctcgcgtccagcctgctgcggaacgacgtgcccatggccggccccctcgtggccggcgggctgctgatcgcctgctacgtcatcaccggcacgtccgccgacctcaccgtggagaaggcggccgacgtgacctgggaggaggaggccgagcagaccggggtcagccacaacctgatgatcaccgtggacgacgacggcacgatgcgcatcaaggacgacgagaccgagaacatcctgaccgtgctcctgaagaccgccctgctcatcgtctccgggatcttcccgtacagcatccccgccacgctgctggtgtggcacacctggcagaagcagacccagcggtccggcgtgctctgggacgtccccagcccgcccgagacccagaaggcggagctggaggagggcgtgtaccgcatcaagcagcaggggatcctgggcaagacccaggtgggggtcggcgtgcagaaggagggggtgttccacaccatgtggcacgtcacccggggcgccgtgctcacccacaacggcaagcgcctggagcccaactgggcctccgtgaagaaggacctgatcagctacgggggcgggtggcggctctccgcccagtggcagaagggcgaggaggtccaggtgatcgcggtggagcccgggaagaaccccaagaacttccagacgatgcccggcaccttccagaccaccacgggcgagatcggggccatcgccctggacttcaagcccggcaccagcgggagccccatcatcaaccgcgagggcaaggtcgtgggcctgtacgggaacggcgtggtcaccaagaacgggggctacgtgtccgggatcgcccagaccaacgccgagccggacggccccacgcccgagctggaggaggagatgttcaagaagcggaacctcaccatcatggacctgcaccccggcagcgggaagacccgcaagtacctgccggcgatcgtgcgggaggccatcaagcgccggctccgcaccctgatcctggcccccacgcgggtcgtggccgccgagatggaggaggcgctcaagggcctgcccatccgctaccagaccaccgccaccaagtccgagcacacggggcgggagatcgtggacctgatgtgccacgccaccttcaccatgcgcctcctgagccccgtccgggtgccgaactacaacctgatcatcatggacgaggcccacttcaccgaccccgcctccatcgcggcccgcggctacatcagcacgcgggtggggatgggcgaggccgccgcgatcttcatgtccgccacgccgcccggcaccgccgacgccttcccgcagagcaacgcccccatccaggacgaggagcgcgacatccccgagcgctcctggaacagcgggaacgagtggatcaccgacttcgcgggcaagacggtctggttcgtgccctccatcaaggccgggaacgacatcgccaactgcctccggaagaacggcaagaaggtgatccagctgagccgcaagaccttcgacaccgagtaccagaagaccaagctgaacgactgggacttcgtcgtgacgaccgacatctccgagatgggggccaacttcaaggccgaccgggtgatcgacccgcgccggtgcctcaagcccgtcatcctgaccgacggccccgagcgcgtgatcctggcgggccccatgccggtgaccgccgccagcgccgcccagcggcgcgggcgggtcggccgcaacccccagaaggagaacgaccagtacatcttcaccgggcagcccctcaacaacgacgaggaccacgcgcactggacggaggccaagatgctgctggacaacatcaacacccccgagggcatcatcccggccctcttcgagcccgagcgggagaagtccgccgcgatcgacggggagtaccgcctgaagggcgagagccggaagaccttcgtggagctgatgcgccggggcgacctccccgtgtggctggcccacaaggtcgcctccgaggggatcaagtacaccgaccgcaagtggtgcttcgacggccagcggaacaaccagatcctggaggagaacatggacgtggagatctggacgaaggagggggagaagaagaagctccgcccccggtggctggacgcccgcacctacagcgacccgctggccctcaaggagttcaaggacttcgcggccggccgcaagtccatcgccctggacctggtcaccgagatcggccgggtgcccagccacctcgcccaccgcacccggaacgccctggacaacctggtgatgctccacacgagcgagcacgggggccgcgcgtaccggcacgccgtcgaggagctgcccgagaccatggagaccctgctcctgctggggctcatgatcctgctgaccggcggggccatgctgttcctgatctccggcaagggcatcgggaagacgagcatcggcctgatctgcgtgatcgcctccagcgggatgctctggatggccgagatcccgctgcagtggatcgcgtccgccatcgtgctggagttcttcatgatggtcctcctgatccccgagcccgagaagcagcgcacgccccaggacaaccagctggcctacgtggtgatcggcatcctcaccctggccgccatcatcgcggccaacgagatggggctgctcgagaccacgaagcgggacctgggcatgagcaaggagccgggcgtcgtgtcccccaccagctacctggacgtggacctccaccccgcctccgcctggaccctgtacgcggtcgccaccacggtgatcacccccatgctgcgccacaccatcgagaacagcaccgccaacgtgtccctcgccgccatcgcgaaccaggccgtcgtgctgatggggctggacaagggctggccgatcagcaagatggacctcggggtgcccctgctggccctcggctgctactcccaggtcaaccccctgacgctgaccgccgccgtgctcctgctgatcacccactacgcgatcatcgggcccggcctccaggccaaggccacccgggaggcccagaagcgcacggccgcgggcatcatgaagaacccgaccgtggacgggatcatcaccatcgacctggaccccgtcatctacgacagcaagttcgagaagcagctgggccaggtgatgctcctggtgctgtgcgccgtccagctcctgctgatgcggacctcctgggccctctgcgaggccctgacgctggcgaccgggcccatcaccaccctctgggagggcagccccggcaagttctggaacacgaccatcgccgtgtccatggccaacatcttccgcgggagctacctggccggcgccgggctggcgttctccatcatgaagtccgtgggcaccgggaagcggggcaccggcagccagggggagaccctcggcgagaagtggaagaagaagctgaaccagctgtcccgcaaggagttcgacctctacaagaagtccgggatcacggaggtcgaccggaccgaggccaaggagggcctgaagcgcggggagaccacccaccacgccgtgtcccggggcagcgccaagctgcagtggctcgtggagcgcaacatggtcatcccggagggccgggtgatcgacctggggtgcggccgcgggggctggtcctactactgcgccgggctgaagaaggtgacggaggtccggggctacaccaagggcgggcccggccacgaggagcccgtgcccatgagcacctacgggtggaacatcgtgaagctcatgtccggcaaggacgtcttctacctgccgcccgagaagtgcgacaccctgctgtgcgacatcggggagagctcccccagccccacggtggaggagtcccgcaccatccgcgtgctcaagatggtcgagccgtggctgaagaacaaccagttctgcatcaaggtgctgaacccctacatgcccgcggtgatcgagcacctcgagcggctgcagcgcaagcacggcggcatgctggtccggaaccccctcagccgcaactccacccacgagatgtactggatcagcaacgggaccggcaacatcgtgtccagcgtgaacatggtctcccggctgctgctcaaccgcttcacgatgacccaccggcgcccgaccatcgagaaggacgtggacctgggggccggcacccggcacgtgaacgccgagcccgagacgcccaacatggacgtcatcggcgagcgcatcaagcggatcaaggaggagcacaacagcacctggcactacgacgacgagaacccgtacaagacctgggcctaccacgggtcctacgaggtgaaggccaccggcagcgcgagctccatgatcaacggggtggtcaagctgctcacgaagccctgggacgtggtccccatggtgacccagatggccatgaccgacaccacgcccttcggccagcagcgcgtgttcaaggagaaggtcgacacccggaccccgcgccccatgcccgggacccggaaggtgatggagatcacggccgagtggctgtggcgcaccctgggccggaacaagcgcccccggctctgcacccgcgaggagttcaccaagaaggtgcgcacgaacgccgcgatgggcgccgtcttcaccgaggagaaccagtgggacagcgccaaggccgccgtggaggacgaggagttctggaagctggtggaccgggagcgcgagctgcacaagctcgggaagtgcggctcctgcgtctacaacatgatggggaagcgggagaagaagctgggcgagttcgggaaggcgaagggcagccgcgccatctggtacatgtggctgggctcccggtacctcgagttcgaggccctggggttcctgaacgaggaccactggttcagccgcgagaactcctacagcggcgtggagggggagggcctccacaagctggggtacatcctgcgggacatctccaagatcccgggcggcgccatgtacgccgacgacaccgcggggtgggacacccgcatcacggaggacgacctccacaacgaggagaagatcacccagcagatggaccccgagcaccggctgctggccaacgccatcttcaagctcacctaccagaacaaggtggtcaaggtgcagcgccccacccccaccggcacggtgatggacatcatcagccggaaggaccagcgcgggtccggccaggtcggcacctacgggctgaacaccttcaccaacatggaggcccagctggtgcggcagatggagggcgagggggtgctcagcaaggccgacctggagaacccgcacctccccgagaagaagatcacgcagtggctcgagaccaagggcgtcgagcgcctgaagcggatggcgatctccggggacgactgcgtggtgaagcccatcgacgaccgcttcgccaacgccctgctcgccctgaacgacatgggcaaggtccggaaggacatcccccagtggcagccgagcaagggctggcacgactggcagcaggtccccttctgctcccaccacttccacgagctgatcatgaaggacgggcgcaagctcgtggtcccctgccggccccaggacgagctgatcggccgcgcccggatcagccagggggcgggctggtccctgcgcgagaccgcctgcctcgggaaggcctacgcccagatgtggagcctgatgtacttccaccgccgggacctgcgcctcgcgtccaacgccatctgcagcgccgtgccggtgcactgggtccccaccagccggacgacctggtccatccacgcccaccaccagtggatgaccaccgaggacatgctgacggtgtggaaccgcgtgtggatcgaggacaacccctggatggaggacaagacccccgtcaccacctgggagaacgtgccgtacctgggcaagcgggaggaccagtggtgcggcagcctcatcgggctgacgtcccgcgccacctgggcgcagaacatccccaccgccatccagcaggtccggagcctgatcggcaacgaggagttcctcgactacatgccctccatgaagcgcttccggaaggaggaggagagcgagggggccatctggtga

SEQ ID NO: 10364 - RNA, 9873 nt, synthetic construct
  misc_feature 1..9873: note = derived and/or modified CDS sequence (opt1) from DENV-3__HQ235027__SS-prME
  source 1..9873: mol_type = other RNA
accagcctgtgcctcatgatgatcctgcccgccgccctggcgttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccatcgagatccagaacagcggcgggacctccatcttcgccggccacctgaagtgccggctgaagatggacaagctcgagctgaagggcatgagctacgccatgtgcaccaagaccttcgtcctgaagaaggaggtgtccgagacgcagcacgggaccatcctcatcaaggtggagtacaagggcgaggacgcgccgtgcaagatccccttcagcaccgaggacgggcagggcaaggcctacaacggccgcctgatcaccgccaaccccgtcgtgacgaagaaggacgagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacatctccatgagcttctcctgcatcgccatcgggatcatcaccctctacctgggcgccgtggtgcaggcggacatggggtgcgtcatcaactggaagggcaaggagctgaagtgcggcagcgggatcttcgtgaccaacgaggtgcacacctggacggagcagtacaagttccaggccgactcccccaagcgcctcgccaccgccatcgccggcgcgtgggagaacggggtctgcggcatccgcagcaccacccggatggagaacctgctgtggaagcagatcgccaacgagctcaactacatcctgtgggagaacaacatcaagctgacggtggtggtcggggacaccatcggcgtgctcgagcagggcaagcgcaccctgacgccccagccgatggagctgaagtactcctggaagacgtgggggaaggccaagatcgtgaccgccgagacccagaacagctccttcatcatcgacggccccaacacccccgagtgccccagcgcgtcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgccgtgcacgcggacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaaccaccggccgggctaccacacccagaccgccgggccctggcacctcggcaagctggagctggacttcaactactgcgagggcaccacggtggtcatcaccgagaactgcgggacccgcggccccagcctccggaccacgaccgtgtccgggaagctgatccacgagtggtgctgccgcagctgcaccctgcccccgctccggtacatgggcgaggacgggtgctggtacggcatggagatccgccccatctccgagaaggaggagaacatggtcaagagcctggtctccgccggcagcgggaaggtggacaacttcaccatgggcgtgctgtgcctcgcgatcctgttcgaggaggtcatgcgggggaagttcggcaagaagcacatgatcgccggggtgttcttcacgttcgtgctgctcctgtccggccagatcacctggcgcgacatggcccacaccctgatcatgatcggcagcaacgcctccgaccggatggggatgggcgtcacctacctcgccctgatcgcgacgttcaagatccagcccttcctggccctcgggttcttcctgcgcaagctgaccagccgggagaacctcctgctgggcgtgggcctcgccatggccaccaccctgcagctgcccgaggacatcgagcagatggcgaacgggatcgccctcggcctgatggccctgaagctcatcacgcagttcgagacctaccagctgtggaccgccctgatcagcctgacctgctccaacacgatgttcaccctgaccgtggcctggcgcaccgcgacgctgatcctcgccggggtcagcctgctgccggtgtgccagtccagctccatgcggaagaccgactggctccccatggccgtcgccgccatgggcgtgccgcccctcccgctgttcatcttcagcctcaaggacaccctgaagcgccgctcctggcccctgaacgagggggtgatggcggtcggcctcgtgagcatcctggcctccagcctgctccggaacgacgtgcccatggccggccccctggtcgccgggggcctgctcatcgcctgctacgtgatcaccgggacgtccgcggacctgaccgtggagaaggccgccgacatcacctgggaggaggaggccgagcagaccggcgtcagccacaacctgatgatcacggtggacgacgacgggaccatgcgcatcaaggacgacgagaccgagaacatcctcaccgtgctgctgaagaccgccctcctggtcgtgtccggcgtgttcccgtacagcatccccgcgacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacctacaacgggaagcgcctggagcccaactgggcctccgtgaagaaggacctgatcagctacggcgggggctggcggctctccgcgcagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggcagccccatcatcaaccgcgagggcaaggtggtcgggctgtacggcaacggggtggtgaccaagaacggcgggtacgtctccggcatcgcccagaccaacgcggagccggacggccccacgcccgagctggaggaggagatgttcaagaagcggaacctcaccatcatggacctgcaccccgggagcggcaagacccgcaagtacctgccggccatcgtgcgggaggccatcaagcgccggctccgcaccctgatcctggcccccacgcgggtggtcgccgcggagatggaggaggccctcaaggggctgcccatccgctaccagaccaccgccaccaagtccgagcacacgggccgggagatcgtggacctgatgtgccacgccaccttcaccatgcgcctcctgagccccgtgcgggtcccgaactacaacctgatcatcatggacgaggcccacttcaccgaccccgcgtccatcgccgcccgcgggtacatcagcacgcgggtgggcatgggcgaggccgcggccatcttcatgaccgccacgccgcccgggaccgccgacgccttcccgcagtccaacgcgcccatccaggacgaggagcgcgacatccccgagcgcagctggaactccggcaacgagtggatcacggacttcgccgggaagaccgtgtggttcgtccccagcatcaaggccggcaacgacatcgccaactgcctccggaagaacgggaagaaggtgatccagctgtcccgcaagaccttcgacaccgagtaccagaagacgaagctgaacgactgggacttcgtggtcaccaccgacatcagcgagatgggcgccaacttcaaggcggaccgggtgatcgacccgcgccggtgcctcaagcccgtgatcctgaccgacggccccgagcgcgtcatcctggccgggcccatgccggtgacggccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgcggccatcgacggcgagtaccgcctgaagggcgagtcccggaagaccttcgtcgagctgatgcgccgcggggacctccccgtgtggctggcccacaaggtcgccagcgagggcatcaagtacacggaccgcaagtggtgcttcgacgggcagcggaacaaccagatcctggaggagaacatggacgtggagatctggaccaaggagggcgagaagaagaagctccgcccccggtggctggacgcccgcacctactccgacccgctggcgctcaaggagttcaaggacttcgccgccggccgcaagagcatcgccctggacctggtgaccgagatcgggcgggtcccctcccacctcgcccaccgcacgcggaacgcgctggacaacctggtgatgctccacaccagcgagcacggcgggcgcgcctaccggcacgccgtggaggagctgcccgagaccatggagaccctgctcctgctgggcctcatgatcctgctgaccggcggggccatgctgttcctgatcagcgggaaggggatcggcaagacctccatcgggctgatctgcgtcatcgccagctccggcatgctctggatggcggagatcccgctgcagtggatcgccagcgccatcgtgctggagttcttcatgatggtgctcctgatccccgagcccgagaagcagcgcacgccccaggacaaccagctggcctacgtcgtgatcgggatcctcaccctggccgcgatcatcgccgccaacgagatgggcctgctcgagacgaccaagcgggacctgggcatgtccaaggagccgggggtggtcagccccacctcctacctggacgtggacctccaccccgccagcgcgtggaccctgtacgccgtggccacgaccgtcatcacccccatgctgcgccacaccatcgagaactccacggccaacgtgagcctcgccgcgatcgccaaccaggccgtggtcctgatgggcctggacaaggggtggccgatctccaagatggacctcggcgtgcccctgctggccctcgggtgctacagccaggtgaaccccctgaccctgaccgccgcggtcctcctgctgatcacccactacgccatcatcggccccggcctccaggccaaggccacgcgggaggcccagaagcgcaccgcggccgggatcatgaagaacccgaccgtggacggcatcatgaccatcgacctggaccccgtgatctacgactccaagttcgagaagcagctggggcaggtcatgctcctggtgctgtgcgccgtgcagctcctgctgatgcggacgagctgggccctctgcgaggcgctgaccctggccaccggccccatcaccacgctctgggagggctcccccgggaagttctggaacaccaccatcgccgtcagcatggccaacatcttccgcggctcctacctggccggggcgggcctggccttcagcatcatgaagtccgtggggaccggcaagcggggcacggggagccagggcgagaccctcggggagaagtggaagaagaagctgaaccagctgagccgcaaggagttcgaccggtacaagaagtccggcatcaccgaggtggaccgcaccgaggccaaggaggggctcaagcggggcgagaccacgcaccacgccgtcagccgcggctccgccaagctgcagtggttcgtggagcggaacatggtgatcccggaggggcgcgtcatcgacctgggctgcgggcggggcgggtggagctactactgcgcgggcctcaagaaggtgaccgaggtgcgcggctacaccaagggcgggcccgggcacgaggagcccgtccccatgtccacctacggctggaacatcgtgaagctgatgagcgggaaggacgtgttctacctgccgcccgagaagtgcgacacgctcctgtgcgacatcggcgagtccagcccctcccccaccgtcgaggagagccgcaccatccgggtgctgaagatggtggagccgtggctgaagaacaaccagttctgcatcaagatcctcaacccctacatgcccaccgtcatcgagcacctggagcgcctgcagcggaagcacggcgggatgctcgtgcgcaaccccctgtcccggaacagcacgcacgagatgtactggatctccaacggcaccgggaacatcgtggccagcgtcaacatggtgtcccgcctgctcctgaaccggttcaccatgacccaccgccggccgacgatcgagaaggacgtggacctgggcgccggcacccgccacgtcaacgccgagcccgagacccccaacatggacgtgatcggggagcggatcaagcgcatcaaggaggagcacaacagcacctggcactacgacgacgagaacccgtacaagacgtgggcctaccacggctcctacgaggtgaaggcgaccgggagcgcctccagcatgatcaacggcgtcgtgaagctcctgaccaagccctgggacgtcgtgcccatggtgacccagatggccatgacggacaccacccccttcgggcagcagcgggtcttcaaggagaaggtggacacccgcacgccgcggagcatgcccggcacccgccgggtgatgggcatcaccgccgagtggctgtggcgcaccctcgggcggaacaagaagccccgcctgtgcacgcgcgaggagttcaccaagaaggtccggaccaacgcggccatgggcgccgtgttcaccgaggagaaccagtgggactccgccaaggccgcggtggaggacgaggacttctggaagctggtcgaccgcgagcgggagctccacaagctggggaagtgcggcagctgcgtgtacaacatgatggggaagcgcgagaagaagctgggcgagttcggcaaggccaaggggtcccgggccatctggtacatgtggctcggcgcccgctacctggagttcgaggccctggggttcctcaacgaggaccactggttcagccgggagaactcctacagcggcgtggagggggagggcctgcacaagctgggctacatcctccgcgacatctccaagatccccgggggcgcgatgtacgccgacgacacggccgggtgggacacccggatcaccgaggacgacctgcacaacgaggagaagatcacccagcagatggacccggagcaccgccagctggccaacgccatcttcaagctcacgtaccagaacaaggtcgtgaaggtgcagcggcccacccccaccggcaccgtcatggacatcatcagccgcaaggaccagcggggctccggccaggtgggcacctacgggctgaacacgttcaccaacatggaggcgcagctgatccgccagatggagggcgagggggtgctcagcaaggccgacctggagaacccccacctccccgagaagaagatcacccagtggctcgagaccaagggcgtcgagcggctgaagcgcatggccatctccggcgacgactgcgtggtgaagcccatcgacgaccggttcgccaacgccctgctcgcgctgaacgacatggggaaggtccgcaaggacatcccccagtggcagcccagcaagggctggcacgactggcagcaggtcccgttctgctcccaccacttccacgagctgatcatgaaggacgggcggaagctcgtggtcccctgccgcccccaggacgagctgatcggccgggcccgcatcagccagggggccggctggtccctgcgcgagacggcctgcctcggcaaggcgtacgcccagatgtggagcctgatgtacttccaccggcgcgacctgcggctcgcctccaacgccatctgcagcgccgtgcccgtgcactgggtcccgacctcccgcaccacctggagcatccacgcgcaccaccagtggatgacgaccgaggacatgctgaccgtgtggaaccgggtgtggatcgaggacaacccctggatggaggacaagacccccgtcacgacctgggaggacgtgccctacctggggaagcgcgaggaccagtggtgcggcagcctcatcgggctgacctcccgggccacctgggcccagaacatcccgacggccatccagcaggtccgcagcctgatcggcaacgaggagttcctcgactacatgccctccatgaagcggttccgcaaggaggaggagagcgagggggccatctggtga

SEQ ID NO: 10365 - RNA, 9873 nt, synthetic construct
  misc_feature 1..9873: note = derived and/or modified CDS sequence (opt1) from DENV-3__JQ920476__SS-prME
  source 1..9873: mol_type = other RNA
accagcctctgcctcatgatgatgctgcccgccaccctggccttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgccccaacgcgtcccgcgcctggaacgtgtgggaggtcgaggactacgggttcggcgtgttcacgaccaacatctggctgaagctgcgggagatgtacacccagctctgcgaccaccgcctgatgagcgccgccgtgaaggacgagcgggccgtccacgcggacatgggctactggatcgagagccagaagaacgggtcctggaagctggagaaggccagcctcatcgaggtgaagacctgcacctggcccaagtcccacacgctgtggagcaacggcgtgctggagtccgacatgatcatccccaagagcctcgccgggcccatctcccagcacaactaccgccccggctaccacacccagaccgccgggccgtggcacctgggcaagctggagctcgacttcaactactgcgagggcaccacggtcgtgatcaccgagaactgcgggacccggggccccagcctgcgcaccacgaccgtgtccgggaagctgatccacgagtggtgctgccggagctgcaccctgccgcccctccgctacatgggcgaggacgggtgctggtacggcatggagatccggccgatcaacgagaaggaggagaacatggtcaagtccctggtgagcgccggctccgggaaggcggacaacttcaccatgggcgtgctctgcctggccatcctgttcgaggaggtcatgcgcgggaagttcggcaagaagcacatgatcgccggggccctcttcacgttcgtgctgctgctcagcggccagatcacctggcgggacatggcccacaccctgatcatgatcggctccaacgcgagcgaccgcatggggatgggcgtgacctacctggccctcatcgccacgttcaagatccagcccttcctggccctggggttcttcctccggaagctgacctcccgcgagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgcagcaacaccatcttcacgctcaccgtggcctggcggaccgccaccctgatcctggccgtcatctccctcctgcccgtgtgccagagctccagcatgcgcaagacggactggctgccgatgaccgtggccgcgatgggggtgccgcccctccccctgttcatcttctccctgaaggacaccctcaagcggcgcagctggccgctgaacgagggcgtgatggccgtcgggctggtgtccatcctcgccagctccttcctgcgcaacgacgtgcccatggccggccccctggtcgccggcgggctcctgatcgcgtgctacgtgatcaccggcacgagcgccgacctgaccgtggagaaggccgccgacgtcacctgggaggaggaggccgagcagaccggggtgtcccacaacctcatgatcacggtggacgacgacggcaccatgcggatcaaggacgacgagaccgagaacatcctgaccgtcctgctcaagaccgcgctgctgatcgtgagcgggatcttcccctactccatcccggccacgctcctggtgtggcacacctggcagaagcagacccagcgcagcggcgtcctgtgggacgtgcccagcccgcccgagacccagaaggccgagctcgaggagggcgtgtaccggatcaagcagcaggggatcttcggcaagacgcaggtcggggtgggcgtgcagaaggagggggtcttccacaccatgtggcacgtgacccgcggcgccgtgctgacccacaacggcaagcggctggagccgaactgggcgaacgtcaagaaggacctcatcagctacgggggcgggtggaagctgtccgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgagcgggtcccccatcatcaaccgcgagggcaaggtggtgggcctgtacgggaacggcgtcgtgaccaagaacgggggctacgtgagcgggatcgcgcagaccaacgccgagcccgacggcccgacccccgagctcgaggaggagatgttcaagaagcggaacctgacgatcatggacctgcaccccggcagcgggaagacccgcaagtacctccccgccatcgtccgggaggccatcaagcgccggctgcgcaccctgatcctcgccccgacccgggtggtggcggccgagatggaggaggccctgaagggcctgcccatccgctaccagacgaccgccaccaagtccgagcacaccgggcgggagatcgtcgacctcatgtgccacgccacgttcaccatgcgcctgctgagccccgtgcgggtgcccaactacaacctcatcgtcatggacgaggcgcacttcaccgacccggcctccatcgccgcccgcggctacatcagcacccgggtggggatgggcgaggcggccgccatcttcatgacggccacgccgcccggcaccgccgacgcgttcccccagtccaacgccccgatccaggacgaggagcgcgacatccccgagcggagctggaactccgggaacgagtggatcaccgacttcgccggcaagacggtgtggttcgtccccagcatcaaggccgggaacgacatcgccaactgcctgcgcaagaacggcaagaaggtgatccagctgtcccgcaagaccttcgacaccgagtaccagaagaccaagctcaacgactgggacttcgtggtcacgaccgacatcagcgagatgggggcgaacttcaaggccgaccgggtgatcgacccccgccggtgcctgaagccggtgatcctgaccgacggccccgagcgcgtcatcctcgccggccccatgcccgtgaccgtggcctccgccgcgcagcggcgcgggcgggtcggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagtcccggaagaccttcgtggagctcatgcgccggggcgacctgcccgtgtggctggcccacaaggtcgccagcgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctactccgaccccctcgcgctgaaggagttcaaggacttcgccgccggccgcaagagcatcgccctggacctcgtcaccgagatcggccgcgtgccgtcccacctggcccaccgcacccggaacgcgctggacaacctcgtgatgctgcacacgagcgagcacgggggccgcgcctaccggcacgccgtcgaggagctgcccgagaccatggagaccctcctgctgctcgggctgatgatcctgctcaccggcggggccatgctgttcctgatctccggcaagggcatcgggaagacgagcatcggcctcatctgcgtggtggccagctccgggatgctgtggatggcggacgtccccctgcagtggatcgccagcgccatcgtgctcgagttcttcatgatggtgctgctgatcccggagcccgagaagcagcgcacgccccaggacaaccagctcgcctacgtcgtgatcggcatcctgaccctggccgcgatcgtggccgccaacgagatggggctcctggagaccacgaagcgggacctgggcatgtccaaggagagcggcgtcgtgtcccccaccagctacctcgacgtggacctgcacccggcctccgcgtggaccctgtacgccgtcgccaccacggtgatcacccccatgctccgccacaccatcgagaacagcaccgccaacgtgtccctggccgcgatcgccaaccaggccgtcgtgctgatggggctcgacaagggctggcccatcagcaagatggacctgggggtgcccctgctcgccctgggctgctactcccaggtcaacccgctgacgctcaccgccgcggtgctgctgctcgtgacccactacgccatcatcgggcccggcctgcaggccaaggccacccgggaggcccagaagcgcacggcggccggcatcatgaagaaccccaccgtcgacgggatcatgaccatcgacctggaccccgtgatctacgacagcaagttcgagaagcagctcggccaggtgatgctgctggtcctctgcgccgtgcagctgctgctcatgcggacctcctgggccttctgcgaggcgctgacgctggccaccgggccgatcaccaccctctgggagggcagccccggcaagttctggaacacgaccatcgccgtgtccatggccaacatcttccgcgggagctacctggccggcgcggggctggccttctccatcatgaagtccgtcggcaccgggaagcggggcaccggctcccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtgtcccggggcagcgccaagctgcagtggttcgtcgagcgcaacatggtgatccccgagggccgggtgatcgacctcgggtgcggccgcgggggctggtcctactactgcgcggggctgaagaaggtcaccgaggtgcggggctacacgaagggcgggcccggccacgaggagccggtgcccatgagcacctacgggtggaacatcgtcaagctgatgtccggcaaggacgtgttctacctgccgcccgagaagtgcgacaccctgctgtgcgacatcggggagagctccccgagccccaccgtggaggagtcccgcacgatccgggtcctgaagatggtggagccctggctcaagaacaaccagttctgcatcaaggtgctgaacccctacatgccgaccgtcatcgagcacctggagcgcctccagcgcaagcacggcggcatgctggtgcggaaccccctgagccgcaactccacccacgagatgtactggatcagcaacgggaccggcaacatcgtgtccagcgtcaacatggtgtcccggctcctgctgaaccgcttcacgatgacccaccggcgccccaccatcgagaaggacgtggacctcggggccggcacccggcacgtcaacgccgagcccgagacgccgaacatggacgtgatcggcgagcgcatccggcgcatcaaggaggagcacagctccacctggcactacgacgacgagaacccctacaagacctgggcctaccacgggagctacgaggtcaaggccaccggctccgcgagcagcatgatcaacggggtggtgaagctgctgacgaagccctgggacgtcgtgccgatggtgacccagatggccatgaccgacaccacgcccttcggccagcagcgggtcttcaaggagaaggtggacacccgcacgccccggcccatgccggggacccgcaaggtgatggagatcaccgccgagtggctctggcggaccctgggccgcaacaagcggccccgcctgtgcacccgggaggagttcatcaagaaggtccgcaccaacgccgcgatgggcgccgtgttcacggaggagaaccagtgggactccgcccgcgccgccgtggaggacgaggagttctggaagctcgtcgaccgggagcgcgagctgcacaagctggggaagtgcggcagctgcgtgtacaacatgatggggaagcgggagaagaagctcggcgagttcgggaaggcgaagggctcccgcgccatctggtacatgtggctgggcgcccggtacctggagttcgaggccctcgggttcctgaacgaggaccactggttcagccgcgagaactcccacagcggcgtggagggggagggcctgcacaagctcgggtacatcctgcgggacatctccaagatccccggcggcgccatgtacgcggacgacaccgccgggtgggacacccgcatcaccgaggacgacctgcacaacgaggagaagatcacgcagcagatggaccccgagcaccggcagctcgccaacgccatcttcaagctgacctaccagaacaaggtcgtgaaggtgcagcgcccgacccccaagggcaccgtcatggacatcatcagccggaaggaccagcgcgggtccggccaggtgggcacgtacgggctgaacaccttcaccaacatggaggcccagctcatccggcagatggagggcgagggggtgctgagcaaggcggacctggagaacccccacctcctggagaagaaggtcacccagtggctggagaccaagggcgtggagcgcctcaagcggatggccatctccggggacgactgcgtggtcaagcccatcgacgaccgcttcgccaacgccctgctggccctcaacgacatgggcaaggtgcggaaggacatcccgcagtggcagcccagcaagggctggcacgactggcagcaggtccccttctgctcccaccacttccacgagctgatcatgaaggacgggcgcaagctggtcgtgccctgccggccgcaggacgagctcatcggccgcgcgcggatcagccagggggccggctggtccctgcgcgagacggcctgcctggggaaggcctacgcgcagatgtgggccctcatgtacttccaccgccgggacctgcgcctggccagcaacgccatctgctccgccgtgcccgtccactgggtgcccaccagccggaccacctggtccatccacgcgcaccaccagtggatgacgaccgaggacatgctcaccgtgtggaaccgcgtctggatcgaggacaacccctggatggaggacaagaccccggtgacgacctgggaggacgtgccctacctgggcaagcgggaggaccagtggtgcggcagcctgatcgggctcaccagccgcgccacctgggcccagaacatcctgacggccatccagcaggtccggtccctgatcggcaacgaggagttcctcgactacatgcccagcatgaagcgcttccggaaggaggaggagtccgagggggccatctggtga

SEQ ID NO: 10366 - RNA, 9873 nt, synthetic construct
  misc_feature 1..9873: note = derived and/or modified CDS sequence (opt1) from DENV-3__JQ920477__SS-prME
  source 1..9873: mol_type = other RNA
accagcctgtgcctgatgatgatgctgcccgccaccctggccttccacctcacctcccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgctgcgcgcctggaacgtgtgggaggtcgaggactacgggttcggcgtgttcacgaccaacatctggctgaagctccgggagaagtacacccagctgtgcgaccaccgcctgatgagcgccgccgtgaaggacgagcgggccgtccacgcggacatgggctactggatcgagagccagaagaacgggtcctggaagctcgagaaggccagcctgatcgaggtgaagacctgcacctggcccaagtcccacacgctgtggagcaacggcgtgctcgagtccgacatgatcatccccaagagcctggccgggcccatctcccagcacaactaccgccccggctaccacacccagaccgccgggccgtggcacctgggcaagctcgagctggacttcaactactgcgagggcaccacggtcgtgatcaccgagaactgcgggacccggggccccagcctgcgcaccacgaccgtgtccgggaagctcatccacgagtggtgctgccggagctgcaccctgccgcccctgcgctacatgggcgaggacgggtgctggtacggcatggagatccggccgatcaacgagaaggaggagaacatggtcaagtccctcgtgagcgccggctccgggaagaccgacaacttcacgatgggcgtgctgtgcctggcgatcctcttcgaggaggtcatgcgcgggaagttcggcaagaagcacatgatcgccggggccctgttcaccttcgtgctgctcctgagcggccagatcacctggcgggacatggcccacaccctgatcatgatcggctccaacgccagcgaccgcatggggatgggcgtgacgtacctcgcgctgatcgccaccttcaagatccagcccttcctggccctcgggttcttcctgcggaagctgacctcccgcgagaacctcctgctgggcgtcggcctcgccatggcgaccacgctgcagctgcccgaggacatcgagcagatggccaacgggatcgccctcggcctgatggccctgaagctcatcacccagttcgagacctaccagctgtggaccgccctggtgagcctcatgtgcagcaacacgatcttcaccctgaccgtggcgtggcggaccgccacgctgatcctcgccgtcatctccctgctgcccgtgtgccagagctccagcatgcgcaagaccgactggctcccgatgaccgtggccgccatgggggtgccgcccctgcccctgttcatcttctccctcaaggacaccctgaagcggcgcagctggccgctgaacgagggcgtgatggcggtcgggctcgtgtccatcctggccagctccttcctgcgcaacgacgtgcccatggccggccccctcgtcgccggcgggctgctgatcgcctgctacgtgatcacgggcaccagcgcggacctcaccgtggagaaggccgccgacgtcacctgggaggaggaggccgagcagacgggggtgtcccacaacctgatgatcaccgtggacgacgacggcaccatgcggatcaaggacgacgagaccgagaacatcctgaccgtcctcctgaagacggccctgctcatcgtgagcgggatcttcccctactccatcccggcgaccctgctggtgtggcacacctggcagaagcagacccagcgcagcggcgtcctctgggacgtgcccagcccgcccgagacgcagaaggccgagctggaggagggcgtgtaccggatcaagcagcaggggatcttcggcaagacccaggtcggggtgggcgtgcagaaggagggggtcttccacaccatgtggcacgtgacccgcggcgccgtgctgacgcacaacggcaagcggctcgagccgaactgggccaacgtcaagaaggacctgatcagctacgggggcgggtggaagctgtccgcgcagtggcagaagggcgaggaggtccaggtgatcgccgtcgagcccgggaagaaccccaagaacttccagaccatgcccggcatcttccagaccaccacgggcgagatcggggccatcgccctggacttcaagccgggcaccagcgggtcccccatcatcaaccgcgagggcaaggtggtgggcctctacgggaacggcgtcgtgaccaagaacgggggctacgtgagcgggatcgcccagaccaacgcggagcccgacggcccgacgcccgagctggaggaggagatgttcaagaagcggaacctgaccatcatggacctccaccccggcagcgggaagacccgcaagtacctgcccgccatcgtccgggaggccatcaagcgccggctgcgcaccctcatcctggccccgacgcgggtggtggccgcggagatggaggaggccctgaagggcctccccatccgctaccagaccaccgccaccaagtccgagcacacggggcgggagatcgtcgacctgatgtgccacgccaccttcaccatgcgcctgctcagccccgtgcgggtgcccaactacaacctgatcgtcatggacgaggcccacttcaccgacccggcgtccatcgccgcccgcggctacatcagcacgcgggtggggatgggcgaggccgcggccatctccatgaccgccacgccgcccggcaccgccgacgccttcccccagagcaacgcgccgatccaggacgaggagcgcgacatccccgagcggtcctggaacagcgggaacgagtggatcacggacttcgccggcaagaccgtgtggttcgtcccctccatcaaggccgggaacgacatcgccaactgcctgcgcaagaacggcaagaaggtgatccagctcagccgcaagaccttcgacaccgagtaccagaagacgaagctgaacgactgggacttcgtggtcaccaccgacatctccgagatgggggccaacttcaaggcggaccgggtgatcgacccccgccggtgcctgaagccggtgatcctcaccgacggccccgagcgcgtcatcctggccggccccatgcccgtgacggtggccagcgccgcccagcggcgcgggcgggtcggccgcaactcccagaaggagaacgaccagtacatcttcaccgggcagccgctgaacaacgacgaggaccacgcgcactggaccgaggccaagatgctcctggacaacatcaacacccccgagggcatcatccccgccctgttcgagcccgagcgggagaagtccgccgcgatcgacggggagtaccgcctcaagggcgagtcccggaagaccttcgtggagctgatgcgccggggcgacctgccggtgtggctcgcccacaaggtcgccagcgaggggatcaagtacacggaccgcaagtggtgcttcgacggcgagcggaacaaccagatcctggaggagaacatggacgtggagatctggaccaaggagggggagaagaagaagctgcgcccccggtggctcgacgcccgcacctactccgaccccctggccctgaaggagttcaaggacttcgcggccggccgcaagagcatcgccctcgacctggtcaccgagatcggccgcgtgccctcccacctggcccaccgcacgcggaacgccctcgacaacctggtgatgctgcacaccagcgagcacgggggccgcgcgtaccggcacgccgtcgaggagctcccggagaccatggagaccctgctgctcctggggctgatgatcctcctgacgggcggggccatgctgttcctcatcagcggcaagggcatcgggaagacctccatcggcctgatctgcgtggtggccagctccgggatgctgtggatggccgacgtccccctccagtggatcgcgagcgccatcgtgctggagttcttcatgatggtgctgctcatccccgagccggagaagcagcgcacgccccaggacaaccagctggcctacgtcgtgatcggcatcctgaccctcgccgccatcgtggcggccaacgagatggggctgctggagacgaccaagcgggacctcggcatgtccaaggagcccggcgtcgtgagccccacctcctacctggacgtggacctgcacccggccagcgcctggaccctctacgcggtcgccacgaccgtgatcacccccatgctgcgccacaccatcgagaactccacggccaacgtgagcctggccgccatcgcgaaccaggccgtcgtgctcatggggctggacaagggctggcccatctccaagatggacctgggggtgcccctcctggccctgggctgctacagccaggtcaacccgctcaccctgaccgccgccgtgctgctcctggtgacccactacgcgatcatcgggcccggcctgcaggccaaggccacgcgggaggcccagaagcgcaccgccgcgggcatcatgaagaaccccaccgtcgacgggatcatgaccatcgacctcgaccccgtgatctacgactccaagttcgagaagcagctgggccaggtgatgctgctcgtcctgtgcgccgtgcagctgctcctgatgcggacgagctgggccttctgcgaggccctgaccctcgcgaccgggccgatcaccacgctgtgggagggctcccccggcaagttctggaacaccaccatcgccgtgagcatggccaacatcttccgcgggtcctacctggccggcgccgggctcgcgttcagcatcatgaagtccgtcggcaccgggaagcggggcacgggcagccagggggagaccctgggcgagaagtggaagaagaagctgaaccagctcagccgcaaggagttcgacctgtacaagaagtccgggatcaccgaggtggaccggaccgaggccaaggagggcctgaagcgcggggagatcacccaccacgccgtgagccggggctccgccaagctccagtggttcgtcgagcgcaacatggtgatccccgagggccgggtgatcgacctggggtgcggccgcgggggctggagctactactgcgccgggctgaagaaggtcacggaggtgcggggctacaccaagggcgggcccggccacgaggagccggtgcccatgtccacctacgggtggaacatcgtcaagctcatgagcggcaaggacgtgttctacctgccgcccgagaagtgcgacaccctgctgtgcgacatcggggagtccagcccgtcccccacggtggaggagagccgcaccatccgggtcctcaagatggtggagccctggctgaagaacaaccagttctgcatcaaggtgctgaacccctacatgccgaccgtcatcgagcacctcgagcgcctgcagcgcaagcacggcggcatgctggtgcggaaccccctctcccgcaacagcacccacgagatgtactggatctccaacgggacgggcaacatcgtgagctccgtcaacatggtgagccggctgctgctcaaccgcttcaccatgacccaccggcgccccaccatcgagaaggacgtggacctgggggcgggcacgcggcacgtcaacgccgagcccgagaccccgaacatggacgtgatcggcgagcgcatccggcgcatcaaggaggagcactccagcacctggcactacgacgacgagaacccctacaagacctgggcctaccacgggtcctacgaggtcaaggccacgggcagcgccagctccatgatcaacggggtggtgaagctgctcaccaagccctgggacgtcgtgccgatggtgacccagatggcgatgaccgacacgacccccttcggccagcagcgggtcttcaaggagaaggtggacacccgcacgccccggcccatgccggggacccgcaaggtgatggagatcaccgccgagtggctgtggcggaccctgggccgcaacaagcggccccgcctctgcacccgggaggagttcatcaagaaggtccgcacgaacgccgccatgggcgcggtgttcaccgaggagaaccagtgggacagcgcccgcgccgccgtggaggacgaggagttctggaagctggtcgaccgggagcgcgagctgcacaagctcgggaagtgcggctcctgcgtgtacaacatgatggggaagcgggagaagaagctgggcgagttcgggaaggccaagggcagccgcgcgatctggtacatgtggctgggcgcccggtacctcgagttcgaggccctggggttcctgaacgaggaccactggttctcccgcgagaacagccactccggcgtggagggggagggcctccacaagctggggtacatcctgcgggacatcagcaagatccccggcggcgccatgtacgccgacgacaccgcggggtgggacacccgcatcacggaggacgacctccacaacgaggagaagatcacccagcagatggaccccgagcaccggcagctggccaacgccatcttcaagctgacctaccagaacaaggtcgtgaaggtgcagcgcccgacccccaagggcacggtcatggacatcatctcccggaaggaccagcgcgggagcggccaggtgggcacctacgggctcaacaccttcaccaacatggaggcccagctgatccggcagatggagggcgagggggtgctgtccaaggccgacctcgagaacccccacctcctggagaagaaggtcacccagtggctcgagacgaagggcgtggagcgcctgaagcggatggcgatcagcggggacgactgcgtggtcaagcccatcgacgaccgcttcgccaacgccctgctcgccctgaacgacatgggcaaggtgcggaaggacatcccgcagtggcagccctccaagggctggcacgactggcagcaggtccccttctgcagccaccacttccacgagctgatcatgaaggacgggcgcaagctcgtcgtgccctgccggccgcaggacgagctgatcggccgcgcccggatctcccagggggcgggctggagcctgcgcgagaccgcctgcctcgggaaggcctacgcccagatgtgggcgctgatgtacttccaccgccgggacctgcgcctcgcctccaacgccatctgcagcgccgtgcccgtccactgggtgcccacctcccggaccacgtggagcatccacgcccaccaccagtggatgaccaccgaggacatgctgaccgtgtggaaccgcgtctggatcgaggacaacccctggatggaggacaagacgccggtgaccacctgggaggacgtgccctacctgggcaagcgggaggaccagtggtgcggcagcctcatcgggctgacctcccgcgcgacgtgggcccagaacatcctgaccgccatccagcaggtccggagcctcatcggcaacgaggagttcctggactacatgccctccatgaagcgcttccggaaggaggaggagagcgagggggccatctggtga

SEQ ID NO: 10367 - RNA, 9873 nt, synthetic construct
  misc_feature 1..9873: note = derived and/or modified CDS sequence (opt1) from DENV-3__JQ920478__SS-prME
  source 1..9873: mol_type = other RNA
accagcctgtgcctcatgatgatgctgcccgccaccctggccttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgggacaagcggtccgtcgccctggcgccccacgtgggcatggggctggacacccgcacccagacgtggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctcccgcggcaccagcatcttcgccgggcacctgaagtgccggctgaagatggacaagctcgagctgaagggcatgtcctacgccatgtgcctgaacgcgttcgtcctcaagaaggaggtgagcgagacgcagcacggcaccatcctgatcaaggtggagtacaagggggaggacgccccctgcaagatccccttcagcaccgaggacggccaggggaaggcccacaacggccgcctgatcaccgccaaccccatcgtcacgaagaaggaggagcccgtgaacatcgaggcggagcccccgttcggcgagtccaacatcgtgatcgggatcggcgacaaggccctgaagatcaactggtacaagaaggggagctccatcggcaagatgttcgaggccaccgcccgcggggcccgccggatggcgatcctcggcgacaccgcctgggacttcggcagcgtcgggggcgtgctgaactccctggggaagatggtgcaccagatcttcggcagcgcctacaccgccctcttctccggggtcagctggatcatgaagatcggcatcggcgtgctgctgacgtggatcgggctcaactccaagaacaccagcatgtccttcagctgcatcgtgatcggcatcatcaccctgtacctgggggccgtcgtgcaggcggacatgggctgcgtgatcaactggaaggggaaggagctcaagtgcggctccggcatcttcgtcaccaacgaggtgcacacgtggaccgagcagtacaagttccaggccgacagccccaagcgcctggccaccgccatcgccggggcgtgggagaacggcgtgtgcgggatccgctccaccacgcggatggagaacctgctctggaagcagatcgccaacgagctgaactacatcctgtgggagaacaacatcaagctcaccatcgtcgtgggcgacgtgatcggggtcctggagcagggcaagcgcaccctgacgccccagcccatggagctcaagtacagctggaagacgtggggcaaggccaagatcgtgaccgccgagacccagaactccagcttcatcatcgacgggccgaacacccccgagtgcccctccgcgctgcgggcctggaacgtgtgggaggtcgaggactacggcttcggggtgttcacgaccaacatctggctgaagctccgcgagaagtacacccagctgtgcgaccaccggctgatgagcgccgccgtgaaggacgagcgcgccgtccacgcggacatgggctactggatcgagagccagaagaacggctcctggaagctcgagaaggccagcctgatcgaggtgaagacctgcacctggcccaagtcccacacgctgtggagcaacggggtgctcgagtccgacatgatcatccccaagagcctggccggccccatctcccagcacaactaccggcccgggtaccacacccagaccgccggcccgtggcacctggggaagctcgagctggacttcaactactgcgagggcaccacggtcgtgatcaccgagaactgcggcacccgcgggcccagcctgcggaccacgaccgtgtccggcaagctcatccacgagtggtgctgccgcagctgcaccctgccgcccctgcggtacatgggggaggacggctgctggtacgggatggagatccgcccgatcaacgagaaggaggagaacatggtcaagtccctcgtgagcgccggctccggcaagaccgacaacttcacgatgggggtgctgtgcctggcgatcctcttcgaggaggtcatgcggggcaagttcgggaagaagcacatgatcgccggcgccctgttcaccttcgtgctgctcctgagcgggcagatcacctggcgcgacatggcccacaccctgatcatgatcggctccaacgccagcgaccggatgggcatgggggtgacgtacctcgcgctgatcgccaccttcaagatccagcccttcctggccctcggcttcttcctgcgcaagctgacctcccgggagaacctcctgctgggggtcggcctcgccatggcgaccacgctgcagctgcccgaggacatcgagcagatggccaacggcatcgccctcgggctgatggccctgaagctcatcacccagttcgagacctaccagctgtggaccgccctgatcagcctcatgtgcagcaacacgatcttcaccctgaccgtggcgtggcgcaccgccacgctgatcctcgccgtgatctccctgctgcccgtctgccagagctccagcatgcggaagaccgactggctcccgatgaccgtggccgccatgggcgtgccgcccctgcccctgttcatcttctccctcaaggacaccctgaagcgccgcagctggccgctgaacgagggggtcatggcggtgggcctcgtctccatcctggccagctccttcctgcggaacgacgtgcccatggccgggcccctcgtggccggcggcctgctgatcgcctgctacgtcatcacggggaccagcgcggacctcaccgtggagaaggccgccgacgtgacctgggaggaggaggccgagcagacgggcgtctcccacaacctgatgatcaccgtggacgacgacgggaccatgcgcatcaaggacgacgagaccgagaacatcctgaccgtgctcctgaagacggccctgctcatcgtcagcggcatcttcccctactccatcccggcgaccctgctggtgtggcacacctggcagaagcagacccagcggagcggggtgctctgggacgtccccagcccgcccgagacgcagaaggccgagctggaggagggcgtgtaccgcatcaagcagcagggcatcttcgggaagacccaggtgggcgtcggggtgcagaaggagggcgtgttccacaccatgtggcacgtcacccgcggggccgtgctgacgcacaacggcaagcgcctcgagccgaactgggccaacgtgaagaaggacctgatcagctacggcgggggctggaagctgtccgcgcagtggcagaagggggaggaggtccaggtgatcgccgtggagcccggcaagaaccccaagaacttccagaccatgcccgggatcttccagaccaccacgggcgagatcggcgccatcgccctggacttcaagccggggaccagcggctcccccatcatcaaccgggaggggaaggtcgtgggcctctacggcaacggggtggtcaccaagaacggcgggtacgtgagcggcatcgcccagaccaacgcggagcccgacgggccgacgcccgagctggaggaggagatgttcaagaagcgcaacctgaccatcatggacctccaccccggcagcggcaagacccggaagtacctgcccgccatcgtgcgcgaggccatcaagcggcgcctgcggaccctcatcctggccccgacgcgcgtcgtggccgcggagatggaggaggccctgaaggggctccccatccggtaccagaccaccgccaccaagtccgagcacacgggccgcgagatcgtggacctgatgtgccacgccaccttcaccatgcggctgctcagccccgtccgcgtgcccaactacaacctgatcgtgatggacgaggcccacttcaccgacccggcgtccatcgccgcccgggggtacatcagcacgcgcgtcggcatgggggaggccgcggccatcttcatgaccgccacgccgcccggcaccgccgacgccttcccccagtccaacgcgccgatccaggacgaggagcgggacatccccgagcgcagctggaactccggcaacgagtggatcacggacttcgccgggaagaccgtgtggttcgtgcccagcatcaaggccggcaacgacatcgccaactgcctgcgcaagaacgggaagaaggtcatccagctctcccggaagaccttcgacaccgagtaccagaagacgaagctgaacgactgggacttcgtggtgaccaccgacatcagcgagatgggcgccaacttcaaggcggaccgcgtcatcgacccccggcgctgcctgaagccggtgatcctcaccgacgggcccgagcgggtgatcctggccggccccatgcccgtcacggtggcctccgccgcccagcgccggggccgcgtggggcggaacagccagaaggagaacgaccagtacatcttcaccggccagccgctgaacaacgacgaggaccacgcgcactggaccgaggccaagatgctcctggacaacatcaacacccccgaggggatcatccccgccctgttcgagcccgagcgcgagaagtccgccgcgatcgacggcgagtaccggctcaagggggagagccgcaagaccttcgtcgagctgatgcggcgcggcgacctgccggtgtggctcgcccacaaggtggcctccgagggcatcaagtacacggaccggaagtggtgcttcgacggggagcgcaacaaccagatcctggaggagaacatggacgtcgagatctggaccaaggagggcgagaagaagaagctgcggccccgctggctcgacgcccggacctacagcgaccccctggccctgaaggagttcaaggacttcgcggccgggcgcaagtccatcgccctcgacctggtgaccgagatcggccgcgtccccagccacctggcccaccggacgcgcaacgccctcgacaacctggtgatgctgcacacctccgagcacggcgggcgggcgtaccgccacgccgtggaggagctcccggagaccatggagaccctgctgctcctgggcctgatgatcctcctgaccggcggggccatgctgttcctcatcagcgggaaggggatcggcaagaccagcatcgggctgatctgcgtcgtggcctccagcggcatgctgtggatggccgacgtgcccctccagtggatcgcgtccgccatcgtcctggagttcttcatgatggtgctgctcatccccgagccggagaagcagcggacgccccaggacaaccagctggcctacgtggtcatcgggatcctgaccctcgccgccatcgtggcggccaacgagatgggcctgctggagacgaccaagcgcgacctcgggatgagcaaggagcccggcgtggtctcccccaccagctacctggacgtggacctgcacccggcctccgcctggaccctctacgcggtggccacgaccgtcatcacccccatgctgcggcacaccatcgagaacagcacggccaacgtgtccctggccgccatcgcgaaccaggccgtggtcctcatgggcctggacaaggggtggcccatcagcaagatggacctgggcgtgcccctcctggccctggggtgctactcccaggtgaacccgctcaccctgaccgccgccgtcctgctcctggtgacccactacgcgatcatcggccccgggctgcaggccaaggccacgcgcgaggcccagaagcggaccgccgcgggcatcatgaagaaccccaccgtggacggcatcatgaccatcgacctcgaccccgtcatctacgacagcaagttcgagaagcagctgggccaggtgatgctgctcgtgctgtgcgccgtccagctgctcctgatgcgcacgtcctgggccttctgcgaggccctgaccctcgcgaccggcccgatcaccacgctgtgggaggggagccccggcaagttctggaacaccaccatcgccgtgtccatggccaacatcttccggggcagctacctggccggggccggcctcgcgttctccatcatgaagtccgtggggaccggcaagcgcgggacgggctcccagggcgagaccctgggggagaagtggaagaagaagctgaaccagctcagccggaaggagttcgacctgtacaagaagtccggcatcaccgaggtcgaccgcaccgaggccaaggaggggctgaagcggggcgagatcacccaccacgccgtgtcccgcgggagcgccaagctccagtggttcgtggagcggaacatggtcatccccgagggccgcgtgatcgacctgggctgcgggcggggcgggtggtcctactactgcgccggcctgaagaaggtgacggaggtccgcgggtacaccaagggcggccccgggcacgaggagccggtgcccatgagcacctacggctggaacatcgtgaagctcatgtccgggaaggacgtcttctacctgccgcccgagaagtgcgacaccctgctgtgcgacatcggcgagagctccccgagccccacggtggaggagtcccggaccatccgcgtgctcaagatggtcgagccctggctgaagaacaaccagttctgcatcaaggtgctgaacccctacatgccgaccgtgatcgagcacctcgagcgcctgcagcggaagcacgggggcatgctggtccgcaaccccctcagccggaactccacccacgagatgtactggatcagcaacggcacggggaacatcgtgtccagcgtgaacatggtctcccgcctgctgctcaaccggttcaccatgacccaccgccggcccaccatcgagaaggacgtggacctgggcgcggggacgcgccacgtgaacgccgagcccgagaccccgaacatggacgtcatcggcgagcggatccgccggatcaaggaggagcacagctccacctggcactacgacgacgagaacccctacaagacctgggcctaccacggcagctacgaggtgaaggccacggggtccgccagcagcatgatcaacggcgtcgtgaagctgctcaccaagccctgggacctggtgccgatggtcacccagatggcgatgaccgacacgacccccttcgggcagcagcgcgtgttcaaggagaaggtggacacccggacgccccgccccatgccgggcacccggaaggtcatggagatcaccgccgagtggctgtggcgcaccctcgggcggaacaagcgcccccggctgtgcacccgcgaggagttcatcaagaaggtgcgcacgaacgccgccatgggcgcggtgttcaccgaggagaaccagtgggactccgcccgggccgccgtcgaggacgaggagttctggaagctggtggaccgcgagcgggagctccacaagctgggcaagtgcgggagctgcgtgtacaacatgatgggcaagcgcgagaagaagctgggggagttcggcaaggccaaggggtcccgggcgatctggtacatgtggctcggcgcccgctacctggagttcgaggccctgggcttcctcaacgaggaccactggttcagccgggagaactcccacagcggggtcgagggcgaggggctgcacaagctgggctacatcctccgcgacatctccaagatccccgggggcgccatgtacgccgacgacaccgcgggctgggacacccggatcacggaggacgacctgcacaacgaggagaagatcacccagcagatggaccccgagcaccgccagctggccaacgccatcttcaagctcacctaccagaacaaggtggtgaaggtccagcggccgacccccaaggggacggtgatggacatcatcagccgcaaggaccagcggggctccggccaggtgggcacctacggcctgaacaccttcaccaacatggaggcccagctgatccgccagatggagggggagggcgtcctcagcaaggccgacctggagaacccccacctcctggagaagaaggtgacccagtggctggagacgaagggggtggagcggctgaagcgcatggcgatctccggcgacgactgcgtcgtgaagcccatcgacgaccggttcgccaacgccctcctggccctgaacgacatggggaaggtgcgcaaggacatcccgcagtggcagcccagcaagggctggcacgactggcagcaggtccccttctgctcccaccacttccacgagctcatcatgaaggacggccggaagctggtggtgccctgccgcccgcaggacgagctgatcgggcgggcccgcatcagccagggcgcggggtggtccctccgcgagaccgcctgcctgggcaaggcctacgcccagatgtgggcgctgatgtacttccaccggcgcgacctccggctggccagcaacgccatctgctccgccgtccccgtgcactgggtgcccaccagccgcaccacgtggtccatccacgcccaccaccagtggatgaccaccgaggacatgctgaccgtctggaaccgggtgtggatcgaggacaacccctggatggaggacaagacgccggtgaccacctgggaggacgtcccctacctcgggaagcgcgaggaccagtggtgcggcagcctgatcggcctgaccagccgggcgacgtgggcccagaacatcctcaccgccatccagcaggtccgctccctgatcgggaacgaggagttcctggactacatgcccagcatgaagcggttccgcaaggaggaggagtccgagggcgccatctggtga

SEQ ID NO: 10368 - RNA, 9873 nt, synthetic construct
  misc_feature 1..9873: note = derived and/or modified CDS sequence (opt1) from DENV-3__JQ920480__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgactacggcaccctggggctcgagtgcagcccccgcaccggcctggacttcaacgagatgatcctgctcacgatgaagaacaaggcctggatggtgcaccggcagtggttcctggacctgccgctcccctggacctccggcgccaccaccgagacgcccacctggaacaagaaggagctgctggtgaccttcaagaacgcccacgccaagaagcaggaggtcgtggtgctcgggagccaggagggcgcgatgcacaccgccctgacgggggccaccgagatccagacctccggcgggaccagcatcttcgccggccacctgaagtgccgcctcaagatggacaagctggagctgaagggcatgtcctacgccatgtgcctcaacgcgttcgtcctgaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctcaagatcaactggtacaagaagggcagctccatcgggaagatgttcgaggccaccgcccgcggcgcccggcgcatggcgatcctgggcgacaccgcctgggacttcgggagcgtcggcggggtgctgaactccctcggcaagatggtgcaccagatcttcgggagcgcctacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggcggacatggggtgcgtgatcaactggaagggcaaggagctgaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctcctgtggaagcagatcgccaacgagctgaactacatcctctgggagaacaacatcaagctgaccatcgtcgtgggggacgtgatcggcgtcctggagcagggcaagcggaccctcacgccccagcccatggagctgaagtacagctggaagacgtgggggaaggccaagatcgtgaccgccgagacccagaactccagcttcatcatcgacggcccgaacacccccgagtgcccctccgcgctgcgcgcctggaacgtgtgggaggtcgaggactacgggttcggcgtgttcacgaccaacatctggctcaagctgcgggagaagtacacccagctgtgcgaccaccgcctcatgagcgccgccgtgaaggacgagcgggccgtccacgcggacatgggctactggatcgagagccagaagaacgagtcctggaagctggagaaggccagcctgatcgaggtgaagacctgcacctggcccaagtcccacacgctctggagcaacggggtgctggagtccgacatgatcatccccaagagcctggccggccccatctcccagcacaactaccgccccgggtaccacacccagaccgccggcccgtggcacctcgggaagctggagctggacttcaactactgcgagggcaccacggtcgtgatcaccgagaactgcggcacccgggggcccagcctccgcaccacgaccgtgtccggcaagctgatccacgagtggtgctgccggagctgcaccctgccgcccctgcgctacatgggggaggacggctgctggtacgggatggagatccggccgatcaacgagaaggaggagaacatggtcaagtccctggtgagcgccggctccggcaagaccgacaacttcacgatgggggtgctgtgcctcgcgatcctgttcgaggaggtcatgcgcggcaagttcgggaagaagcacatgatcgccggcgccctgttcatgttcgtgctcctgctgagcgggcagatcacctggcgggacatggtgcacaccctcatcatgatcggctccaacgccagcgaccgcatgggcatgggggtcacctacctggccctgatcgcgacgttcaagatccagcccttcctcgccctgggcttcttcctgcggaagctcacctcccgcgagaacctgctgctcggggtgggcctggccatggccaccaccctgcagctccccgaggacatcgagcagatggcgaacggcatcgccctggggctgatggccctcaagctgatcacgcagttcgagacctaccagctgtggaccgccctcatcagcctgatgtgcagcaacaccatcttcacgctgaccgtggcctggcggaccgcgaccctcatcctggccgtcatctccctgctccccgtgtgccagagctccagcatgcgcaagacggactggctgccgatgaccgtggccgccatgggcgtgccgcccctccccctcttcatcttctccctgaaggacaccctgaagcggcgcagctggccgctcaacgagggggtgatggccgtcggcctggtgtccatcctggcgagctccttcctccgcaacgacgtgcccatggccgggcccctggtcgccggcggcctgctcatcgcctgctacgtgatcaccgggacgagcgccgacctgaccgtggagaaggcggccgacgtcacctgggaggaggaggccgagcagaccggcgtgtcccacaacctgatgatcacggtggacgacgacgggaccatgcggatcaaggacgacgagaccgagaacatcctcaccgtcctgctgaagaccgccctcctgatcgtgagcggcatcttcccctactccatcccggccacgctgctcgtgtggcacacctggcagaagcagacccagcgcagcggggtcctgtgggacgtgcccagcccgcccgagacccagaaggcggagctggaggagggcgtgtaccggatcaagcagcagggcatcttcgggaagacgcaggtcggcgtgggggtgcagaaggagggcgtcttccacaccatgtggcacgtgacccgcggggccgtgctcacccacaacggcaagcggctggagccgaactgggccaacgtcaagaaggacctgatcagctacggcgggggctggaagctgtccgcccagtggcagaagggggaggaggtccaggtgatcgcggtcgagcccggcaagaaccccaagaacttccagacgatgcccgggatcttccagaccaccaccggcgagatcggcgccatcgccctcgacttcaagccggggacgagcggctcccccatcatcaaccgcgaggggaaggtggtgggcctgtacggcaacggggtcgtgaccaagaacggcgggtacgtgagcggcatcgcccagaccaacgccgagcccgacgggccgacccccgagctggaggaggagatgttcaagaagcggaacctcacgatcatggacctgcaccccggcagcggcaagacccgcaagtacctgcccgcgatcgtccgggaggccatcaagcgccggctccgcaccctgatcctggccccgacccgggtggtggccgccgagatggaggaggcgctcaaggggctgcccatccgctaccagacgaccgccaccaagtccgagcacaccggccgggagatcgtcgacctgatgtgccacgccacgttcaccatgcgcctcctgagccccgtgcgggtgcccaactacaacctgatcgtcatggacgaggcccacttcaccgacccggcctccatcgcggcccgcgggtacatcagcacccgggtgggcatgggggaggccgccgcgatcttcatgacggccacgccgcccggcaccgccgacgccttcccccagtccaacgccccgatccaggacgaggagcgcgacatccccgagcggagctggaactccggcaacgagtggatcaccgacttcgcggggaagacggtgtggttcgtccccagcatcaaggccggcaacgacatcgccaactgcctccgcaagaacgggaagaaggtgatccagctgtcccgcaagaccttcgacaccgagtaccagaagaccaagctgaacgactgggacttcgtggtcacgaccgacatcagcgagatgggcgccaacttcaaggccgaccgggtgatcgacccccgccggtgcctcaagccggtgatcctgaccgacgggcccgagcgcgtcatcctggcgggccccatgcccgtgaccgtggcctccgccgcccagcggcgcggccgggtcgggcgcaacagccagaaggagaacgaccagtacatcttcacgggccagccgctcaacaacgacgaggaccacgcccactggaccgaggcgaagatgctgctggacaacatcaacacccccgaggggatcatccccgccctcttcgagcccgagcgggagaagtccgccgccatcgacggcgagtaccgcctgaagggggagagccggaagaccttcgtggagctgatgcgccggggcgacctcccggtgtggctggcgcacaaggtcgcctccgagggcatcaagtacaccgaccgcaagtggtgcttcgacggggagcggaacaaccagatcctggaggagaacatggacgtggagatctggacgaaggagggcgagaagaagaagctccgcccccggtggctggacgcccgcacctacagcgaccccctggccctcaaggagttcaaggacttcgccgcggggcggaagtccatcgccctggacctggtcaccgagatcggccgcgtgcccagccacctcgcccaccgcacccggaacgccctggacaacctggtgatgctccacacgtccgagcacggcgggcgcgcctaccggcacgcggtcgaggagctgccggagaccatggagaccctgctcctgctgggcctcatgatcctgctgaccgggggcgccatgctgttcctgatcagcgggaagggcatcggcaagacgagcatcgggctgatctgcgtggtggcctccagcggcatgctctggatggccgacgtccccctgcagtggatcgcctccgcgatcgtgctggagttcttcatgatggtgctcctgatccccgagccggagaagcagcgcacgccccaggacaaccagctggcctacgtcgtgatcgggatcctcaccctggccgccatcgtggccgcgaacgagatgggcctgctcgagaccacgaagcgggacctggggatgagcaaggagcccggcgtcgtgtcccccaccagctacctggacgtggacctccacccggcctccgcctggaccctgtacgccgtcgcgaccacggtgatcacccccatgctgcgccacaccatcgagaacagcaccgccaacgtgtccctcgccgccatcgccaaccaggcggtcgtgctgatgggcctggacaaggggtggcccatcagcaagatggacctcggcgtgcccctgctggccctcgggtgctactcccaggtcaacccgctgacgctgaccgccgccgtgctcctgctggtgacccactacgccatcatcggccccgggctccaggcgaaggccacccgggaggcccagaagcgcacggccgccggcatcatgaagaaccccaccgtcgacggcatcatgaccatcgacctggaccccgtgatctacgacagcaagttcgagaagcagctgggccaggtgatgctcctggtcctgtgcgcggtgcagctcctgctgatgcggacctcctgggccttctgcgaggccctcacgctggccaccggcccgatcaccaccctgtgggaggggagccccggcaagttctggaacacgaccatcgcggtgtccatggccaacatcttccgcggcagctacctcgccggggccggcctggccttctccatcatgaagtccgtcgggaccggcaagcgggggaccggctcccagggcgagacgctgggggagaagtggaagaagaagctcaaccagctgagccgcaaggagttcgacctgtacaagaagtccggcatcaccgaggtggaccggaccgaggcgaaggaggggctcaagcgcggcgagatcacccaccacgccgtgtcccgggggagcgccaagctgcagtggttcgtcgagcgcaacatggtgatccccgagggccgggtgatcgacctgggctgcgggcgcggcgggtggtcctactactgcgccggcctcaagaaggtcaccgaggtgcgggggtacacgaagggcggccccgggcacgaggagccggtgcccatgagcacctacggctggaacatcgtcaagctgatgtccgggaaggacgtgttctacctgccgcccgagaagtgcgacaccctgctctgcgacatcggcgagagctccccgagccccaccgtggaggagtcccgcacgatccgggtcctgaagatggtggagccctggctgaagaacaaccagttctgcatcaaggtgctcaacccctacatgccgaccgtcatcgagcacctggagcgcctgcagcgcaagcacgggggcatgctcgtgcggaaccccctgagccgcaactccacccacgagatgtactggatcagcaacggcaccgggaacatcgtgtccagcgtcaacatggtgtcccggctgctcctgaaccgcttcacgatgacccaccggcgccccaccatcgagaaggacgtggacctgggcgccgggacccggcacgtcaacgcggagcccgagacgccgaacatggacgtgatcggcgagcgcatccggcgcatcaaggaggagcacagctccacctggcactacgacgacgagaacccctacaagacctgggcctaccacggcagctacgaggtcaaggccaccgggtccgccagcagcatgatcaacggcgtggtgaagctcctgacgaagccctgggacgtcgtgccgatggtgacccagatggccatgaccgacaccacgcccttcgggcagcagcgggtcttcaaggagaaggtggacacccgcacgccccggcccatgccgggcacccgcaaggtgatggagatcaccgcggagtggctgtggcggaccctcgggcgcaacaagcggccccgcctgtgcacccgggaggagttcatcaagaaggtccgcaccaacgccgccatgggcgccgtgttcacggaggagaaccagtgggactccgcgcgcgccgccgtggaggacgaggagttctggaagctggtcgaccgggagcgcgagctccacaagctgggcaagtgcgggagctgcgtgtacaacatgatgggcaagcgggagaagaagctgggggagttcggcaaggccaaggggtcccgcgccatctggtacatgtggctcggcgcgcggtacctggagttcgaggccctgggcttcctcaacgaggaccactggttcagccgcgagaactcccacagcggggtggagggcgaggggctgcacaagctgggctacatcctccgggacatctccaagatccccgggggcgccatgtacgccgacgacaccgccggctgggacacccgcatcaccgaggacgacctgcacaacgaggagaagatcacgcagcagatggaccccgagcaccggcagctggcgaacgccatcttcaagctcacctaccagaacaaggtcgtgaaggtgcagcgcccgacccccaaggggaccgtcatggacatcatcagccggaaggaccagcgcggctccggccaggtgggcacgtacggcctgaacaccttcaccaacatggaggcccagctgatccggcagatggagggggagggcgtgctcagcaaggccgacctggagaacccccacctcctcgagaagaaggtcacccagtggctggagaccaagggggtggagcgcctgaagcggatggccatctccggcgacgactgcgtggtcaagcccatcgacgaccgcttcgcgaacgccctcctggccctgaacgacatggggaaggtgcggaaggacatcccgcagtggcagcccagcaagggctggcacgactggcagcaggtccccttctgctcccaccacttccacgagctcatcatgaaggacggccgcaagctggtcgtgccctgccggccgcaggacgagctgatcgggcgcgcccggatcagccagggcgccgggtggtccctccgcgagacggcgtgcctgggcaaggcctacgcccagatgtgggccctgatgtacttccaccgccgggacctccgcctggcgagcaacgccatctgctccgccgtgcccgtccactgggtgcccaccagccggaccacctggtccatccacgcccaccaccagtggatgacgaccgaggacatgctgaccgtgtggaaccgcgtctggatcgaggacaacccctggatggaggacaagaccccggtgacgacctgggaggacgtgccctacctcgggaagcgggaggaccagtggtgcggcagcctgatcggcctgaccagccgcgccacctgggcgcagaacatcctcacggccatccagcaggtccggtccctgatcgggaacgaggagttcctggactacatgcccagcatgaagcgcttccggaaggaggaggagtccgagggcgccatctggtga

SEQ ID NO: 10369 - RNA, 9873 nt, synthetic construct
  misc_feature 1..9873: note = derived and/or modified CDS sequence (opt1) from DENV-3__JQ920479__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcctccgggatcaacatgtgcaccctcatcgccatggacctgggggagatgtgcgacgacaccgtgacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcacccagacgtggatgagcgcggagggcgcctggcggcaggtcgagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcctggacctgccgctcccctggacctccggcgccaccaccgagacgcccacctggaacaagaaggagctgctggtgaccttcaagaacgcccacgccaagaagcaggaggtcgtggtgctcgggagccaggagggcgcgatgcacaccgccctgacgggggccaccgagatccagacctccggcgggaccagcatcttcgccggccacctgaagtgccgcctcaagatggacaagctggagctgaagggcatgtcctacgccatgtgcctcaacgcgttcgtcctgaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctcaagatcaactggtacaagaagggcagctccatcgggaagatgttcgaggccaccgcccgcggcgcccggcgcatggcgatcctgggcgacaccgcctgggacttcgggagcgtcggcggggtgctgaactccctcggcaagatggtgcaccagatcttcgggagcgcctacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggcggacatggggtgcgtgatcaactggaagggcaaggagctgaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctcctgtggaagcagatcgccaacgagctgaactacatcctctgggagaacaacatcaagctgaccatcgtcgtgggggacgtgatcggcgtcctggagcagggcaagcggaccctcacgccccagcccatggagctgaagtacagctggaagacgtgggggaaggccaagatcgtgaccgccgagacccagaactccagcttcatcatcgacggcccgaacacccccgagtgcccctccgcgctgcgcgcctggaacgtgtgggaggtcgaggactacgggttcggcgtgttcacgaccaacatctggctcaagctgcgggagaagtacacccagctgtgcgaccaccgcctcatgagcgccgccgtgaaggacgagcgggccgtccacgcggacatgggctactggatcgagagccagaagaacgagtcctggaagctggagaaggccagcctgatcgaggtgaagacctgcacctggcccaagtcccacacgctctggagcaacggggtgctggagtccgacatgatcatccccaagagcctggccggccccatctcccagcacaactaccgccccgggtaccacacccagaccgccggcccgtggcacctcgggaagctggagctggacttcaactactgcgagggcaccacggtcgtgatcaccgagaactgcggcatccgggggcccagcctccgcaccaccacggtgtccggcaagctgatccacgagtggtgctgccggagctgcaccctgccgcccctgcgctacatgggggaggacggctgctggtacgggatggagatccggccgatcaacgagaaggaggagaacatggtcaagtccctggtgagcgccggctccggcaagaccgacaacttcaccatgggggtgctgtgcctcgcgatcctgttcgaggaggtcatgcgcggcaagttcgggaagaagcacatgatcgccggcgccctgttcatgttcgtgctcctgctgagcgggcagatcacgtggcgggacatggtgcacaccctcatcatgatcggctccaacgccagcgaccgcatgggcatgggggtcacctacctggccctgatcgcgaccttcaagatccagcccttcctcgccctgggcttcttcctgcggaagctcacgtcccgcgagaacctgctgctcggggtgggcctggccatggccaccaccctgcagctccccgaggacatcgagcagatggcgaacggcatcgccctggggctgatggccctcaagctgatcacccagttcgagacgtaccagctgtggaccgccctcatcagcctgatgtgcagcaacaccatcttcaccctgacggtggcctggcggaccgcgaccctcatcctggccgtcatctccctgctccccgtgtgccagagctccagcatgcgcaagaccgactggctgccgatgacggtggccgccatgggcgtgccgcccctccccctcttcatcttctccctgaaggacaccctgaagcggcgcagctggccgctcaacgagggggtgatggccgtcggcctggtgtccatcctggcgagctccttcctccgcaacgacgtgcccatggccgggcccctggtcgccggcggcctgctcatcgcctgctacgtgatcaccgggaccagcgccgacctgacggtggagaaggcggccgacgtcacctgggaggaggaggccgagcagaccggcgtgtcccacaacctgatgatcaccgtggacgacgacgggacgatgcggatcaaggacgacgagaccgagaacatcctcaccgtcctgctgaagaccgccctcctgatcgtgagcggcatcttcccctactccatcccggccaccctgctcgtgtggcacacgtggcagaagcagacccagcgcagcggggtcctgtgggacgtgcccagcccgcccgagacccagaaggcggagctggaggagggcgtgtaccggatcaagcagcagggcatcttcgggaagacccaggtcggcgtgggggtgcagaaggagggcgtcttccacacgatgtggcacgtgacccgcggggccgtgctcacccacaacggcaagcggctggagccgaactgggccaacgtcaagaaggacctgatcagctacggcgggggctggaagctgtccgcccagtggcagaagggggaggaggtccaggtgatcgcggtcgagcccggcaagaaccccaagaacttccagaccatgcccgggatcttccagacgaccaccggcgagatcggcgccatcgccctcgacttcaagccggggaccagcggctcccccatcatcaaccgcgaggggaaggtggtgggcctgtacggcaacggggtcgtgacgaagaacggcgggtacgtgagcggcatcgcccagaccaacgccgagcccgacgggccgacccccgagctggaggaggagatgttcaagaagcggaacctcaccatcatggacctgcaccccggcagcggcaagacgcgcaagtacctgcccgcgatcgtccgggaggccatcaagcgccggctccgcaccctgatcctggccccgacccgggtggtggccgccgagatggaggaggcgctcaaggggctgcccatccgctaccagaccacggccaccaagtccgagcacaccggccgggagatcgtcgacctgatgtgccacgccaccttcacgatgcgcctcctgagccccgtgcgggtgcccaactacaacctgatcgtcatggacgaggcccacttcaccgacccggcctccatcgcggcccgcgggtacatcagcacccgggtgggcatgggggaggccgccgcgatcttcatgaccgccacgccgcccggcaccgccgacgccttcccccagtccaacgccccgatccaggacgaggagcgcgacatccccgagcggagctggaactccggcaacgagtggatcaccgacttcgcggggaagaccgtgtggttcgtccccagcatcaaggccggcaacgacatcgccaactgcctccgcaagaacgggaagaaggtgatccagctgtcccgcaagacgttcgacaccgagtaccagaagaccaagctgaacgactgggacttcgtggtcaccacggacatcagcgagatgggcgccaacttcaaggccgaccgggtgatcgacccccgccggtgcctcaagccggtgatcctgaccgacgggcccgagcgcgtcatcctggcgggccccatgcccgtgaccgtggcctccgccgcccagcggcgcggccgggtcgggcgcaacagccagaaggagaacgaccagtacatcttcaccggccagccgctcaacaacgacgaggaccacgcccactggacggaggcgaagatgctgctggacaacatcaacacccccgaggggatcatccccgccctcttcgagcccgagcgggagaagtccgccgccatcgacggcgagtaccgcctgaagggggagagccggaagaccttcgtggagctgatgcgccggggcgacctcccggtgtggctggcgcacaaggtcgcctccgagggcatcaagtacaccgaccgcaagtggtgcttcgacggggagcggaacaaccagatcctggaggagaacatggacgtggagatctggaccaaggagggcgagaagaagaagctccgcccccggtggctggacgcccgcacgtacagcgaccccctggccctcaaggagttcaaggacttcgccgcggggcggaagtccatcgccctggacctggtcaccgagatcggccgcgtgcccagccacctcgcccaccgcacccggaacgccctggacaacctggtgatgctccacacctccgagcacggcgggcgcgcctaccggcacgcggtcgaggagctgccggagacgatggagaccctgctcctgctgggcctcatgatcctgctgaccgggggcgccatgctgttcctgatcagcgggaagggcatcggcaagaccagcatcgggctgatctgcgtggtggcctccagcggcatgctctggatggccgacgtccccctgcagtggatcgcctccgcgatcgtgctggagttcttcatgatggtgctcctgatccccgagccggagaagcagcgcacgccccaggacaaccagctggcctacgtcgtgatcgggatcctcaccctggccgccatcgtggccgcgaacgagatgggcctgctcgagaccaccaagcgggacctggggatgagcaaggagcccggcgtcgtgtcccccacgagctacctggacgtggacctccacccggcctccgcctggaccctgtacgccgtcgcgaccaccgtgatcacgcccatgctgcgccacaccatcgagaacagcaccgccaacgtgtccctcgccgccatcgccaaccaggcggtcgtgctgatgggcctggacaaggggtggcccatcagcaagatggacctcggcgtgcccctgctggccctcgggtgctactcccaggtcaacccgctgaccctgacggccgccgtgctcctgctggtgacccactacgccatcatcggccccgggctccaggcgaaggccacccgggaggcccagaagcgcaccgccgccggcatcatgaagaaccccacggtcgacggcatcatgaccatcgacctggaccccgtgatctacgacagcaagttcgagaagcagctgggccaggtgatgctcctggtcctgtgcgcggtgcagctcctgctgatgcggacctcctgggccttctgcgaggccctcaccctggccacgggcccgatcaccaccctgtgggaggggagccccggcaagttctggaacaccacgatcgcggtgtccatggccaacatcttccgcggcagctacctcgccggggccggcctggccttctccatcatgaagtccgtcgggaccggcaagcgggggaccggctcccagggcgagaccctgggggagaagtggaagaagaagctcaaccagctgagccgcaaggagttcgacctgtacaagaagtccggcatcacggaggtggaccggaccgaggcgaaggaggggctcaagcgcggcgagatcacccaccacgccgtgtcccgggggagcgccaagctgcagtggttcgtcgagcgcaacatggtgatccccgagggccgggtgatcgacctgggctgcgggcgcggcgggtggtcctactacagcgccggcctcaagaaggtcaccgaggtgcgggggtacaccaagggcggccccgggcacgaggagccggtgcccatgtccacgtacggctggaacatcgtcaagctgatgagcgggaaggacgtgttctacctgccgcccgagaagtgcgacaccctgctctgcgacatcggcgagtccagcccgtcccccaccgtggaggagagccgcaccatccgggtcctgaagatggtggagccctggctgaagaacaaccagttctgcatcaaggtgctcaacccctacatgccgacggtcatcgagcacctggagcgcctgcagcgcaagcacgggggcatgctcgtgcggaaccccctgtcccgcaacagcacccacgagatgtactggatctccaacggcaccgggaacatcgtgagctccgtcaacatggtgagccggctgctcctgaaccgcttcaccatgacgcaccggcgccccaccatcgagaaggacgtggacctgggcgccgggacccggcacgtcaacgcggagcccgagaccccgaacatggacgtgatcggcgagcgcatccggcgcatcaaggaggagcactccagcacgtggcactacgacgacgagaacccctacaagacctgggcctaccacggctcctacgaggtcaaggccaccgggagcgccagctccatgatcaacggcgtggtgaagctcctgaccaagccctgggacgtcgtgccgatggtgacgcagatggccatgaccgacaccacccccttcgggcagcagcgggtcttcaaggagaaggtggacacgcgcacgccccggcccatgccgggcacccgcaaggtgatggagatcaccgcggagtggctgtggcggaccctcgggcgcaacaagcggccccgcctgtgcacccgggaggagttcatcaagaaggtccgcaccaacgccgccatgggcgccgtgttcaccgaggagaaccagtgggacagcgcgcgcgccgccgtggaggacgaggagttctggaagctggtcgaccgggagcgcgagctccacaagctgggcaagtgcgggtcctgcgtgtacaacatgatgggcaagcgggagaagaagctgggggagttcggcaaggccaaggggagccgcgccatctggtacatgtggctcggcgcgcggtacctggagttcgaggccctgggcttcctcaacgaggaccactggttctcccgcgagaacagccactccggggtggagggcgaggggctgcacaagctgggctacatcctccgggacatcagcaagatccccgggggcgccatgtacgccgacgacacggccggctgggacacccgcatcaccgaggacgacctgcacaacgaggagaagatcacccagcagatggaccccgagcaccggcagctggcgaacgccatcttcaagctcacgtaccagaacaaggtcgtgaaggtgcagcgcccgacccccaaggggaccgtcatggacatcatctcccggaaggaccagcgcggcagcggccaggtgggcacctacggcctgaacacgttcaccaacatggaggcccagctgatccggcagatggagggggagggcgtgctctccaaggccgacctggagaacccccacctcctcgagaagaaggtcacccagtggctggagaccaagggggtggagcgcctgaagcggatggccatcagcggcgacgactgcgtggtcaagcccatcgacgaccgcttcgcgaacgccctcctggccctgaacgacatggggaaggtgcggaaggacatcccgcagtggcagccctccaagggctggcacgactggcagcaggtccccttctgcagccaccacttccacgagctcatcatgaaggacggccgcaagctggtcgtgccctgccggccgcaggacgagctgatcgggcgcgcccggatctcccagggcgccgggtggagcctccgcgagaccgcgtgcctgggcaaggcctacgcccagatgtgggccctgatgtacttccaccgccgggacctccgcctggcgtccaacgccatctgcagcgccgtgcccgtccactgggtgcccacgtcccggaccacctggagcatccacgcccaccaccagtggatgaccacggaggacatgctgaccgtgtggaaccgcgtctggatcgaggacaacccctggatggaggacaagaccccggtgaccacgtgggaggacgtgccctacctcgggaagcgggaggaccagtggtgcggcagcctgatcggcctgacctcccgcgccacctgggcgcagaacatcctcaccgccatccagcaggtccggagcctgatcgggaacgaggagttcctggactacatgccctccatgaagcgcttccggaaggaggaggagagcgagggcgccatctggtga

SEQ ID NO: 10370 - RNA, 9873 nt, synthetic construct
  misc_feature 1..9873: note = derived and/or modified CDS sequence (opt1) from DENV-3__KU216208__SS-prME
  source 1..9873: mol_type = other RNA
accagcctgtgcctcatgatgatcctgcccgccgccctggcgttccacctcaccagccgggacggggagccccggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctggatcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtgtgcaagcacgcctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcaccgtgcacacgggggaccagcaccaggtcggcaacgagacccagggggtgaccgccgagatcacgccccaggcgagcacgaccgaggccatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggacgagcggcgccaccaccgagacccccacgtggaaccgcaaggagctcctggtgaccttcaagaacgcccacgcgaagaagcaggaggtggtcgtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtgctgaagaaggaggtctccgagacgcagcacgggaccatcctcatcaaggtggagtacaagggcgaggacgccccgtgcaagatccccttcagcaccgaggacgggcagggcaaggcccacaacggccgcctgatcaccgccaaccccgtggtcacgaagaaggaggagcccgtgaacatcgaggcggagccgcccttcggggagagcaacatcgtgatcggcatcggggacaacgccctgaagatcaactggtacaagaagggctccagcatcgggaagatgttcgaggccaccgcccggggcgcccgccggatggcgatcctgggcgacaccgcctgggacttcgggtccgtcggcggggtgctcaacagcctgggcaagatggtgcaccagatcttcgggtccgcctacaccgccctgttcagcggcgtctcctgggtgatgaagatcggcatcggggtgctcctgacgtggatcggcctgaacagcaagaacacctccatgagcttctcctgcatcgccatcgggatcatcaccctctacctgggcgcggtcgtgcaggccgacatggggtgcgtggtcaactggaagggcaaggagctgaagtgcggcagcgggatcttcgtgaccaacgaggtgcacacgtggaccgagcagtacaagttccaggccgactcccccaagcgcctcgccaccgccatcgcgggcgcctgggagaacggggtctgcggcatccgcagcaccacgcggatggagaacctgctgtggaagcagatcgccaacgagctcaactacatcctgtgggagaacaacatcaagctgaccgtggtggtcggggacaccatcggcgtgctcgagcagggcaagcgcaccctgacgccccagccgatggagctgaagtactcctggaagacctgggggaaggccaagatcgtgaccgcggagacccagaacagctccttcatcatcgacggccccaacacgcccgagtgccccagcgcctcccgggcctggaacgtctgggaggtggaggactacgggttcggcgtgttcaccaccaacatctggctcaagctgcgcgaggtctacacccagatgtgcgaccaccggctgatgagcgccgccgtgaaggacgagcgcgcggtgcacgccgacatgggctactggatcgagagccagaagaacgggtcctggaagctcgagaaggccagcctgatcgaggtcaagacctgcacgtggccgaagtcccacaccctgtggagcaacggcgtgctcgagtccgacatgatcatccccaagagcctggccgggcccatctcccagcacaactaccggccgggctaccacacccagaccgccgggccctggcacctgggcaagctcgagctggacttcaactactgcgagggcacgaccgtggtcatcaccgagaactgcgggacccgcggccccagcctgcggacgaccaccgtgtccgggaagctcatccacgagtggtgctgccgcagctgcaccctgcccccgctgcggtacatgggcgaggacgggtgctggtacggcatggagatccgccccatctccgagaaggaggagaacatggtcaagagcctcgtctccgcgggcagcgggaaggtggacaacttcacgatgggcgtgctgtgcctggccatcctcttcgaggaggtcatgcgggggaagttcggcaagaagcacatgatcgccggggtgttcttcaccttcgtgctgctgctctccggccagatcacctggcgcgacatggcccacaccctgatcatgatcggcagcaacgcctccgaccggatggggatgggcgtcacgtacctggcgctcatcgccaccttcaagatccagcccttcctggccctggggttcttcctccgcaagctgaccagccgggagaacctgctcctgggcgtgggcctggccatggcgaccacgctccagctgcccgaggacatcgagcagatggccaacgggatcgccctgggcctcatggccctgaagctgatcacccagttcgagacctaccagctctggaccgccctgatcagcctgacgtgctccaacaccatcttcaccctcaccgtggcgtggcgcacggccaccctgatcctggccggggtcagcctcctgccggtgtgccagtccagctccatgcggaagaccgactggctgcccatgaccgtcgccgccatgggcgtgccgcccctcccgctgttcatcttcagcctgaaggacacgctcaagcgccgctcctggcccctgaacgagggggtgatggcggtcggcctggtgagcatcctcgcctccagcctgctgcggaacgacgtgcccatggccggccccctcgtcgccgggggcctgctgatcgcctgctacgtgatcaccgggacctccgcggacctcaccgtggagaaggccgccgacgtcacgtgggaggaggaggccgagcagaccggcgtgagccacaacctgatgatcaccgtggacgacgacgggaccatgcgcatcaaggacgacgagaccgagaacatcctgacggtcctcctgaagaccgccctgctcatcgtgtccggcatcttcccgtacagcatccccgcgaccctgctggtgtggcacacctggcagaagcagacgcagcggtccggcgtcctctgggacgtgcccagcccgcccgagacccagaaggccgagctggaggagggggtgtaccgcatcaagcagcagggcatcctggggaagacccaggtcggcgtgggggtgcagaaggagggcgtcttccacaccatgtggcacgtgacgcggggcgccgtgctcacccacaacgggaagcgcctggagcccaactgggcctccgtcaagaaggacctgatcagctacggcgggggctggcggctctccgcgcagtggcagaagggggaggaggtccaggtgatcgccgtcgagcccggcaagaaccccaagaacttccagaccatgcccggcaccttccagacgaccaccggggagatcggcgccatcgccctggacttcaagcccgggaccagcggcagccccatcatcaaccgcgagggcaaggtggtggggctgtacggcaacggggtcgtgacgaagaacggcgggtacgtgtccggcatcgcccagaccaacgcggagccggacggccccacccccgagctggaggaggagatgttcaagaagcggaacctcaccatcatggacctgcaccccgggagcggcaagacgcgcaagtacctgccggccatcgtccgggaggccatcaagcgccggctccgcaccctgatcctggcccccacccgggtggtggccgcggagatggaggaggccctcaaggggctgcccatccgctaccagaccacggccaccaagtccgagcacaccggccgggagatcgtcgacctgatgtgccacgccaccttcacgatgcgcctcctgagccccgtgcgggtgccgaactacaacctgatcatcatggacgaggcccacttcaccgaccccgcgtccatcgccgcccgcgggtacatcagcacccgggtcggcatgggcgaggccgcggccatcttcatgaccgccacgccgcccgggaccgccgacgccttcccgcagtccaacgcgcccatccaggacgaggagcgcgacatccccgagcgcagctggaactccggcaacgagtggatcaccgacttcgccgggaagaccgtgtggttcgtgcccagcatcaaggccggcaacgacatcgccaactgcctccggaagaacgggaagaaggtcatccagctgtcccgcaagacgttcgagaccgagtaccagaagaccaagctgaacgactgggacttcgtggtgaccacggacatcagcgagatgggcgccaacttcaaggcggaccgggtcatcgacccgcgccggtgcctcaagcccgtgatcctgaccgacggccccgagcgcgtgatcctggccgggcccatgccggtcaccgccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacacgcccgaggggatcatcccggccctcttcgagcccgagcgggagaagtccgcggccatcgacggcgagtaccgcctgaagggcgagtcccggaagaccttcgtggagctgatgcgccgcggggacctccccgtctggctggcctacaaggtggccagcgagggcatcaagtacaccgaccgcaagtggtgcttcgacgggcagcggaacaaccagatcctggaggagaacatggacgtcgagatctggaccaaggagggcgagaagaagaagctccgcccccggtggctggacgcccgcacgtactccgacccgctggcgctcaaggagttcaaggacttcgccgccggccgcaagagcatcgccctggacctggtgaccgagatcgggcgggtgccctcccacctcgcccaccgcacccggaacgcgctggacaacctggtcatgctccacaccagcgagcacggcgggcgcgcctaccggcacgccgtggaggagctgcccgagacgatggagaccctgctcctgctgggcctcatgatcctgctgaccgggggcgccatgctgttcctgatcagcggcaaggggatcggcaagacctccatcgggctgatctgcgtgatcgccagctccggcatgctctggatggcggagatcccgctgcagtggatcgccagcgccatcgtcctggagttcttcatgatggtgctcctgatccccgagcccgagaagcagcgcacgccccaggacaaccagctggcctacgtggtcatcgggatcctcaccctggccgcgatcatcgccgccaacgagatgggcctgctcgagaccaccaagcgggacctgggcatgtccaaggagccgggggtggtgagccccacgtcctacctggacgtcgacctccaccccgccagcgcgtggaccctgtacgccgtggccaccaccgtgatcacgcccatgctgcgccacaccatcgagaactccaccgccaacgtcagcctcgccgcgatcgccaaccaggccgtggtgctgatgggcctggacaaggggtggccgatctccaagatggacctcggcgtccccctgctggccctcgggtgctacagccaggtgaaccccctgaccctgacggccgcggtgctcctgctgatcacccactacgccatcatcggccccggcctccaggccaaggccacccgggaggcccagaagcgcaccgcggccgggatcatgaagaacccgacggtcgacggcatcatcaccatcgacctggaccccgtgatctacgactccaagttcgagaagcagctgggccaggtgatgctcctggtcctgtgcgccgtgcagctcctgctgatgcggaccagctgggccctctgcgaggcgctgaccctggccacgggccccatcaccaccctctgggagggctcccccgggaagttctggaacaccacgatcgccgtgagcatggccaacatcttccgcggctcctacctggccggggcgggcctggccttcagcatcatgaagtccgtcgggaccggcaagcggggcaccgggagccagggcgagaccctcggggagaagtggaagaagaagctgaaccagctgagccgcaaggagttcgacctctacaagaagtccggcatcaccgaggtggaccggacggaggccaaggaggggctgaagcgcggcgagaccacccaccacgccgtgagccggggctccgccaagctgcagtggttcgtcgagcgcaacatggtgatcccggaggggcgggtgatcgacctcggctgcgggcgcggcgggtggagctactactgcgcgggcctgaagaaggtcaccgaggtgcggggctacacgaagggcgggcccgggcacgaggagcccgtgcccatggccacctacggctggaacatcgtcaagctgatgtccgggaaggacgtgttctacctcccgcccgagaagtgcgacaccctgctgtgcgacatcggcgagagctcccccagccccaccgtggaggagtcccgcacgatccgcgtcctgaagatggtggagccgtggctcaagaacaaccagttctgcatcaaggtgctgaacccctacatgcccgccgtcatcgagcacctggagcggctccagcgcaagcacggcgggatgctggtgcggaaccccctgagccgcaactccacccacgagatgtactggatcagcaacggcaccgggaacatcgtgtccagcgtcaacatggtgtcccggctcctgctgaaccgcttcaccatgacgcaccggcgcccgaccatcgagaaggacgtggacctcggcgccggcacccggcacgtcaacgccgagcccgagacccccaacatggacgtgatcggggagcgcatcaagcggatcaaggaggagcacaacagcacgtggcactacgacgacgagaacccgtacaagacctgggcgtaccacggctcctacgaggtgaaggccaccgggagcgcctccagcatgatcaacggcgtcgtgaagctgctgaccaagccctgggacgtcgtgcccatggtgacgcagatggccatgaccgacaccacccccttcgggcagcagcgcgtcttcaaggagaaggtggacacgcggaccccgcgccccatgcccggcacccggaaggtgatggagatcaccgcggagtggctctggcgcacgctgggccggaacaagcgcccccggctgtgcacccgcgaggagttcaccaagaaggtccgcaccaacgccgccatgggggccgtgttcacggaggagaaccagtgggacagcgccaaggcggccgtggaggacgaggagttctggaagctcgtcgaccgggagcgcgagctgcacaagctgggcaagtgcgggtcctgcgtgtacaacatgatgggcaagcgggagaagaagctcggggagttcggcaaggccaagggcagccgcgccatctggtacatgtggctgggggcccggtacctggagttcgaggcgctcggcttcctgaacgaggaccactggttctcccgcgagaacagctactccggggtggagggcgaggggctgcacaagctcggctacatcctgcgggacatcagcaagatcccgggcggggccatgtacgccgacgacaccgccggctgggacacccgcatcaccgaggacgacctgcacaacgaggagaagatcacgcagcagatggaccccgagcaccggctcctggccaacgcgatcttcaagctgacctaccagaacaaggtcgtgaaggtgcagcgccccacccccaccgggaccgtcatggacatcatctcccggaaggaccagcgcggcagcggccaggtggggacgtacggcctcaacaccttcaccaacatggaggcccagctggtgcggcagatggagggggagggcgtcctgtccaaggccgacctcgagaacccgcacctccccgagaagaagatcacccagtggctggagacgaagggggtggagcgcctcaagcggatggccatcagcggcgacgactgcgtggtcaagcccatcgacgaccgcttcgccaacgcgctgctggccctcaacgacatgggcaaggtgcggaaggacatcccccagtggcagccgtccaaggggtggcacgactggcagcaggtccccttctgcagccaccacttccacgagctgatcatgaaggacggccgcaagctggtcgtgccctgccggccccaggacgagctcatcgggcgcgcccggatctcccagggcgccgggtggagcctgcgcgagaccgcgtgcctgggcaaggcctacgcccagatgtggtccctcatgtacttccaccgccgggacctgcgcctggccagcaacgccatctgctccgcggtgccggtccactgggtgcccaccagccggaccacgtggtccatccacgcccaccaccagtggatgaccaccgaggacatgctcaccgtgtggaaccgcgtctggatcgaggacaacccctggatggaggacaagacgcccgtgaccacctgggagaacgtgccgtacctgggcaagcgggaggaccagtggtgcgggagcctgatcggcctcaccagccgcgccacgtgggcccagaacatccccaccgccatccagcaggtccggtccctgatcgggaacgaggagttcctggactacatgcccagcatgaagcgcttccggaaggaggaggagtccgagggcgcgatctggtga

SEQ ID NO: 10371 - RNA, 9873 nt, synthetic construct
  misc_feature 1..9873: note = derived and/or modified CDS sequence (opt1) from DENV-3__GU370053__SS-prME
  source 1..9873: mol_type = other RNA
accagcctctgcctcatgatgatcctgcccgcggccctggcgttccacctcaccagccgggacggcgagccccggatgatcgtggggaagaacgagcggggcaagagcctgctgttcaagacggcctccgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctgggccagcggcgccaccaccgagacccccacgtggaaccgcaaggagctcctggtgaccttcaagaacgcccacgcgaagaagcaggaggtcgtggtgctggggtcccaggagggcgccatgcacaccgccctcaccggggccacggagatccagaacagcggcgggacctccatcttcgccggccacctgaagtgccggctgaagatggacaagctcgagctgaagggcatgagctacgcgatgtgcaccaacaccttcgtcctgaagaaggaggtgtccgagacgcagcacgggaccatcctcatcaaggtggagtacaagggcgaggacgccccgtgcaagatccccttcagcaccgaggacgggcagggcaaggcccacaacggccgcctgatcaccgccaaccccgtcgtgacgaagaaggaggagcccgtgaacatcgaggcggagccgcccttcggggagagcaacatcgtcatcggcatcggggacaacgccctgaagatcaactggtacaagaagggctccagcatcgggaagatgttcgaggccaccgcccggggcgcccgccggatggcgatcctgggcgacaccgcctgggacttcgggtccgtgggcggggtgctcaacagcctgggcaagatggtccaccagatcttcgggtccgcctacaccgccctgttcagcggcgtgtcctgggtgatgaagatcggcatcggggtcctcctgacgtggatcggcctgaacagcaagaacacctccatgagcttctcctgcatcgccatcgggatcatcaccctctacctgggcgcggtggtgcaggccgacatggggtgcgtcatcaactggaagggcaaggagctgaagtgcggcagcgggatcttcgtgaccaacgaggtgcacacgtggaccgagcagtacaagttccaggccgactcccccaagcgcctcgccaccgccatcgcgggcgcctgggagaacggggtctgcggcatccgcagcaccacgcggatggagaacctgctgtggaagcagatcgccaacgagctcaactacatcctgtgggagaacaacatcaagctgaccgtggtggtcggggacaccatcggcgtgctcgagcagggcaagcgcaccctgacgccccagccgatggagctgaagtactcctggaagacctgggggaaggccaagatcgtgaccgcggagatccagaacagctccttcatcatcgacggccccaacacccccgagtgccccagcgcctcccgggcctggaacgtctgggaggtggaggactacgggttcggcgtgttcacgaccaacatctggctcaagctgcgcgaggtctacacccagctgtgcgaccaccggctcatgagcgccgccgtgaaggacgagcgcgcggtgcacgccgacatgggctactggatcgagagccagaagaacgggtcctggaagctggagaaggccagcctgatcgaggtcaagacctgcacctggccgaagtcccacacgctctggagcaacggcgtgctggagtccgacatgatcatccccaagagcctggccgggcccatctcccagcacaactaccggccgggctaccacacccagaccgccgggccctggcacctcggcaagctggagctggacttcaactactgcgagggcaccacggtggtcatcaccgagagctgcgggacccgcggcccctccctccggaccacgaccgtgagcgggaagctgatccacgagtggtgctgccgctcctgcaccctgcccccgctccggtacatgggcgaggacgggtgctggtacggcatggagatccgccccatcagcgagaaggaggagaacatggtgaagtccctggtcagcgcgggctccgggaaggtggacaacttcaccatgggcgtgctgtgcctcgccatcctgtacgaggaggtcatgcgggggaagttcggcaagaagcacatgatcgccggggtgttcttcacgttcgtgctgctcctgagcggccagatcacctggcgcgacatggcccacaccctgatcatgatcggctccaacgccagcgaccggatggggatgggcgtcacctacctcgcgctgatcgccacgttcaagatccagcccttcctggccctcgggttcttcctgcgcaagctgaccagccgggagaacctcctgctgggcgtgggcctcgccatggcgaccaccctgcagctgcccgaggacatcgagcagatggccaacgggatcgccctcggcctgatggccctgaagctcatcacgcagttcgagacctaccagctgtggaccgccctggtgtccctgacctgcagcaacacgatcttcaccctgaccgtcgcgtggcgcaccgccacgctgatcctcgccggggtgtccctgctgccggtctgccagagctccagcatgcggaagaccgactggctccccatggccgtggccgcgatgggcgtgccgcccctcccgctgttcatcttctccctcaaggacaccctgaagcgccgcagctggcccctgaacgagggggtcatggccgtgggcctcgtgtccatcctggccagctccctgctccggaacgacgtccccatggccggccccctggtggccgggggcctgctcatcgcgtgctacgtgatcaccgggacgagcgccgacctgaccgtcgagaaggccgccgacgtgacctgggaggaggaggccgagcagaccggcgtgtcccacaacctgatgatcacggtcgacgacgacgggaccatgcgcatcaaggacgacgagaccgagaacatcctcaccgtgctgctgaagaccgcgctcctgatcgtgagcggcatcttcccgtactccatccccgccacgctgctcgtctggcacacctggcagaagcagacccagcggagcggcgtgctgtgggacgtgcccagcccgcccgagacccagaaggccgagctggaggagggggtctaccgcatcaagcagcagggcatcttcgggaagacccaggtgggcgtgggggtccagaaggagggcgtgttccacaccatgtggcacgtgacccggggcgccgtcctcacccacaacgggaagcgcctggagcccaactgggcgagcgtgaagaaggacctgatctcctacggcgggggctggcggctcagcgcccagtggcagaagggggaggaggtgcaggtcatcgccgtggagcccggcaagaaccccaagaacttccagacgatgcccggcaccttccagaccaccacgggggagatcggcgccatcgccctggacttcaagcccgggaccagcggctcccccatcatcaaccgcgagggcaaggtggtcgggctgtacggcaacggggtggtgaccaagaacggcgggtacgtcagcggcatcgcgcagaccaacgccgagccggacggccccacgcccgagctggaggaggagatgttcaagaagcggaacctcaccatcatggacctgcaccccgggtccggcaagacccgcaagtacctgccggccatcgtgcgggaggccatcaagcgccggctccgcaccctgatcctggcccccacgcgggtggtcgcggccgagatggaggaggccctcaaggggctgcccatccgctaccagaccaccgccaccaagagcgagcacacgggccgggagatcgtggacctgatgtgccacgccaccttcaccatgcgcctcctgtcccccgtgcgggtcccgaactacaacctgatcgtgatggacgaggcgcacttcaccgaccccgccagcatcgccgcccgcgggtacatctccacgcgggtgggcatgggcgaggcggccgccatcttcatgaccgccacgccgcccgggaccgccgacgcgttcccgcagagcaacgcccccatccaggacgaggagcgcgacatccccgagcgctcctggaacagcggcaacgagtggatcacggacttcgccgggaagaccgtctggttcgtgccctccatcaaggccggcaacgacatcgccaactgcctccggaagaacgggaagaaggtgatccagctgagccgcaagaccttcgacaccgagtaccagaagacgaagctgaacgactgggacttcgtcgtgaccaccgacatctccgagatgggcgcgaacttcaaggccgaccgggtgatcgacccgcgccggtgcctcaagcccgtcatcctgaccgacggccccgagcgcgtgatcctggccgggcccatgccggtgacggccgccagcgcggcccagcggcgcggccgggtcgggcgcaacccccagaaggagaacgaccagtacatcttcaccggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgaagggcgagagccggaagaccttcgtggagctgatgcgccgcggggacctccccgtctggctggcccacaaggtggcctccgagggcatcaagtacacggaccgcaagtggtgcttcgacgggcagcggaacaaccagatcctggaggagaacatggacgtggagatctggaccaaggagggcgagaagaagaagctccgcccccggtggctggacgcgcgcacctacagcgacccgctggccctcaaggagttcaaggacttcgccgccggccgcaagtccatcgccctggacctggtcaccgagatcgggcgggtgcccagccacctcgcgcaccgcacgcggaacgccctggacaacctggtgatgctccacaccagcgagcacggcgggcgcgcctaccggcacgccgtcgaggagctgcccgagaccatggagaccctgctcctgctgggcctcatgatcctgctgaccggcggggccatgctgttcctgatctccgggaaggggatcggcaagaccagcatcgggctgatctgcgtgatcgcgtccagcggcatgctctggatggccgaggtgccgctgcagtggatcgcctccgccatcgtcctggagttcttcatgatggtgctcctgatccccgagcccgagaagcagcgcacgccccaggacaaccagctggcctacgtggtcatcgggatcctcaccctggcggccatcatcgccgccaacgagatgggcctgctcgagacgaccaagcgggacctgggcatgagcaaggagccgggggtggtgtcccccaccagctacctggacgtcgacctccaccccgcgtccgcctggaccctgtacgccgtggccacgaccgtgatcacccccatgctgcgccacaccatcgagaacagcacggccaacgtctccctcgcggccatcgccaaccaggccgtggtgctgatgggcctggacaaggggtggccgatcagcaagatggacctcggcgtccccctgctggccctcgggtgctactcccaggtgaaccccctgaccctgaccgcggccgtgctcctgctgatcacccactacgccatcatcggccccggcctccaggccaaggccacgcgggaggcgcagaagcgcaccgccgccgggatcatgaagaacccgaccgtcgacggcatcatgaccatcgacctggaccccgtgatctacgacagcaagttcgagaagcagctgggccaggtgatgctcctggtcctgtgcgccgtgcagctcctgctgatgcggacgtcctgggcgctctgcgaggccctgaccctggccaccggccccatcaccacgctctgggagggcagccccgggaagttctggaacaccaccatcgccgtgtccatggccaacatcttccgcggcagctacctggcgggggccggcctggccttctccatcatgaagtccgtcgggaccggcaagcggggcacggggagccagggcgagaccctcggggagaagtggaagaagaagctgaaccagctgtcccgcaaggagttcgacctctacaagaagtccggcatcaccgaggtggaccggaccgaggccaaggaggggctgaagcgcggcgagaccacgcaccacgccgtgtcccggggcagcgcgaagctgcagtggttcgtcgagcgcaacatggtggtgccggaggggcgggtcatcgacctcggctgcgggcgcggcgggtggtcctactactgcgccggcctgaagaaggtgaccgaggtgcggggctacaccaagggcgggcccgggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccgtggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtctccagcgtgaacatggtgtcccggctcctgctgaaccgcttcaccatgacccaccggcgcccgacgatcgagaaggacgtcgacctcggcgccggcacccggcacgtgaacgccgagcccgagacccccaacatggacgtcatcggggagcgcatcaagcggatcaaggaggagcacaacagcacctggcactacgacgacgagaacccgtacaagacgtgggcctaccacggctcctacgaggtgaaggcgaccgggagcgccagctccatgatcaacggcgtggtcaagctgctgaccaagccctgggacgtggtgcccatggtcacccagatggccatgacggacaccacccccttcgggcagcagcgcgtgttcaaggagaaggtggacacccggacgccgcgccccatgcccggcacccggaaggtcatggagatcaccgccgagtggctctggcgcaccctgggccggaacaagcgcccccggctgtgcacgcgcgaggagttcaccaagaaggtgcgcaccaacgcggccatgggggccgtgttcaccgaggagaaccagtgggacagcgccaaggccgcggtcgaggacgaggagttctggaagctcgtggaccgggagcgcgagctgcacaagctgggcaagtgcgggtcctgcgtgtacaacatgatgggcaagcgggagaagaagctcggggagttcggcaaggccaagggcagccgcgccatctggtacatgtggctgggggcccggtacctggagttcgaggccctcggcttcctgaacgaggaccactggttctcccgcgagaacagctactccggggtcgagggcgaggggctgcacaagctcggctacatcctgcgggacatcagcaagatcccgggcggggcgatgtacgccgacgacacggccggctgggacacccgcatcaccgaggacgacctgcacaacgaggagaagatcatccagcagatggaccccgagcaccggcagctcgccaacgccatcttcaagctgacctaccagaacaaggtggtgaaggtccagcgccccacgcccaccgggaccgtgatggacatcatctcccggaaggaccagcgcggcagcggccaggtggggacctacggcctgaacaccttcacgaacatggaggcgcagctcgtccggcagatggagggggagggcgtgctgaccaaggccgacctggagaacccgcacctccccgagaagaagatcacccagtggctggagaccaagggggtggagcgcctgaagcggatggccatctccggcgacgactgcgtcgtgaagcccatcgacgaccgcttcgccaacgccctcctggcgctgaacgacatgggcaaggtgcggaaggacatcccccagtggcagccgagccgcgggtggcacgactggcagcaggtccccttctgctcccaccacttccacgagctcatcatgaaggacggccggaagctggtggtgccctgccgcccccaggacgagctgatcgggcgggcccgcatcagccagggcgccgggtggtccctccgcgagacggcctgcctgggcaaggcgtacgcccagatgtggagcctgatgtacttccaccggcgcgacctccggctggcctccaacgccatctgcagcgccgtcccggtgcactgggtgcccacctcccgcaccacctggagcatccacgcgcaccaccagtggatgacgaccgaggacatgctgaccgtctggaaccgggtgtggatcgaggagaacccctggatggaggacaagacccccgtgacgacctgggagaacgtcccgtacctcggcaagcgcgaggaccagtggtgcgggagcctgatcggcctgacctcccgggccacctgggcccagaacatcctcacggccatccagcaggtccgcagcctgatcgggaacgaggagttcctggactacatgccctccatgaagcggttccgcaaggaggaggagagcgagggcgccatctggtga

SEQ ID NO: 10372 - RNA, 9873 nt, synthetic construct
  misc_feature 1..9873: note = derived and/or modified CDS sequence (opt1) from DENV-3__JQ411814__SS-prME
  source 1..9873: mol_type = other RNA
accagcctctgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtggggatcggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtccaccggcagtggttcttcgacctgcccctgccctggaccagcggcgccaccaccgagacgcccacctggaaccgcaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtgctgaagaaggaggtctccgagacccagcacgggaccatcctcatcaaggtggagtacaagggcgaggacgcgccgtgcaagatccccttcagcaccgaggacgggcagggcaaggcccacaacggccgcctgatcacggccaaccccgtggtcaccaagaaggaggagcccgtgaacatcgaggccgagccgcccttcggggagagcaacatcgtgatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtcggcggggtgctcaacagcctgggcaagatggtgcaccagatcttcgggtccgcctacacggccctgttcagcggcgtctcctgggtgatgaagatcggcatcggggtgctcctgacctggatcggcctgaacagcaagaacacctccatgagcttctcctgcatcgccatcgggatcatcaccctctacctgggcgccgtcgtgcaggcggacatggggtgcgtgatcaactggaagggcaaggagctgaagtgcggcagcgggatcttcgtcacgaacgaggtgcacacctggaccgagcagtacaagttccaggccgactcccccaagcgcctcgccaccgccatcgccggcgcgtgggagaacggggtgtgcggcatccgcagcacgacccggatggagaacctgctgtggaagcagatcgccaacgagctcaactacatcctgtgggagaacaacatcaagctgaccgtcgtggtgggggacaccatcggcgtcctcgagcagggcaagcgcacgctgacgccccagccgatggagctgaagtactcctggaagacctgggggaaggccaagatcgtgaccgccgagacgcagaacagctccttcatcatcgacggccccaacacccccgagtgccccagcgcgtcccgggcctggaacgtgtgggaggtcgaggactacgggttcggcgtgttcaccaccaacatctggctcaagctgcgcgacgtgtacacccagctgtgcgaccaccggctcatgagcgccgccgtcaaggacgagcgcgccgtgcacgcggacatgggctactggatcgagagccagaagaacgggtcctggaagctggagaaggccagcctgatcgaggtgaagacgtgcacctggccgaagtcccacaccctctggagcaacggcgtcctggagtccgacatgatcatccccaagagcctggccgggcccatctcccagcacaactaccggccgggctaccacacccagacggccgggccctggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgccggcagcgggaaggtcgacaacttcaccatgggcgtgctgtgcctcgcgatcctgttcgaggaggtgatgcgggggaagttcggcaagaagcacatgatcgccggggtcctgttcaccttcgtgctcctgctgtccggccagatcacctggcgcgacatggcccacacgctcatcatgatcggcagcaacgcctccgaccggatggggatgggcgtgacctacctggccctgatcgcgaccttcaagatccagcccttcctcgccctggggttcttcctgcgcaagctcaccagccgggagaacctgctgctcggcgtcggcctggccatggccacgaccctgcagctccccgaggacatcgagcagatggcgaacgggatcgccctgggcctgatggccctcaagctgatcacccagttcgagacctaccagctgtggacggccctcgtgagcctgacctgctccaacaccatcctgaccctcacggtggcctggcgcaccgcgaccctgatcctggccggggtcagcctcctgccggtgtgccagtccagctccatgcggaagaccgactggctgcccatgacggtcgccgccatgggcgtgccgcccctcccgctgttcatcttcagcctgaaggacaccctcaagcgccgctcctggcccctgaacgagggggtgatggccgtcggcctggtgagcatcctcgcgtccagcctgctgcggaacgacgtgcccatggccggccccctcgtcgccgggggcctgctgatcgcctgctacgtgatcaccgggacctccgccgacctcacggtggagaaggcggccgacgtcacctgggaggaggaggccgagcagaccggcgtgagccacaacctgatgatcaccgtggacgacgacgggaccatgcgcatcaaggacgacgagacggagaacatcctgaccgtcctcctgaagaccgccctgctcatcgtgtccggcatcttcccgtacagcatccccgccaccctgctggtgtggcacacgtggcagaagcagacccagcggtccggcgtcctctgggacgtgcccagcccgcccgagacccagaaggcggagctggaggagggggtgtaccgcatcaagcagcagggcatcctggggaagacccaggtcggcgtgggggtgcagaaggagggcgtcttccacacgatgtggcacgtgacccggggcgccgtgctcacccacaacgggaagcgcctggagcccaactgggcctccgtcaagaaggacctgatcagctacggcgggggctggcggctgtccgcccagtggcagaagggggaggaggtccaggtgatcgcggtcgagcccggcaagaaccccaagaacttccagaccatgcccggcacgttccagaccaccaccggggagatcggcgccatcgccctcgacttcaagcccgggacgagcggcagccccatcatcaaccgcgagggcaaggtggtggggctgtacggcaacggggtcgtgaccaagaacggcgggtacgtgtccggcatcgcccagaccaacgccgagccggacggccccacccccgagctggaggaggagatgttcaagaagcggaacctcacgatcatggacctgcaccccgggagcggcaagacccgcaagtacctgccggcgatcgtccgggaggccatcaagcgccggctccgcaccctgatcctggcccccacccgggtggtggccgccgagatggaggaggcgctcaaggggctgcccatccgctaccagacgaccgccaccaagtccgagcacaccggccgggagatcgtcgacctgatgtgccacgccacgttcaccatgcgcctcctgagccccgtgcgggtgccgaactacaacctgatcatcatggacgaggcccacttcaccgaccccgcctccatcgcggcccgcgggtacatcagcacccgggtcggcatgggcgaggccgccgcgatcttcatgacggccacgccgcccgggaccgccgacgccttcccgcagtccaacgcccccatccaggacgaggagcgcgacatccccgagcgcagctggaactccggcaacgagtggatcaccgacttcgcggggaagacggtgtggttcgtgcccagcatcaaggccggcaacgacatcgccaactgcctccggaagaacgggaagaaggtcatccagctgtcccgcaagaccttcgacaccgagtaccagaagaccaagctgaacgactgggacttcgtggtgacgaccgacatcagcgagatgggcgccaacttcaaggccgaccgggtcatcgacccgcgccggtgcctcaagcccgtgatcctgaccgacggccccgagcgcgtgatcctggcggggcccatgccggtcaccgccgcctccgccgcccagcggcgcggccgggtggggcgcaacccccagaaggagaacgaccagtacatcttcaccggccagcccctcaacaacgacgaggaccacgcgcactggacggaggccaagatgctgctggacaacatcaacacccccgaggggatcatcccggccctcttcgagcccgagcgggagaagtccgccgcgatcgacggcgagtaccgcctgaagggcgagtcccggaagaccttcgtggagctgatgcgccgcggggacctccccgtctggctggcccacaaggtggccagcgagggcatcaagtacaccgaccgcaagtggtgcttcgacgggcagcggaacaaccagatcctggaggagaacatggacgtcgagatctggacgaaggagggcgagaagaagaagctccgcccccggtggctggacgcccgcacctactccgacccgctggccctcaaggagttcaaggacttcgcggccggccgcaagagcatcgccctggacctggtgaccgagatcgggcgggtgccctcccacctcgcccaccgcacccggaacgccctggacaacctggtcatgctccacacgagcgagcacggcgggcgcgcgtaccggcacgccgtggaggagctgcccgagaccatggagaccctgctcctgctgggcctcatgatcctgctgaccgggggcgccatgctgttcctgatcagcggcaaggggatcggcaagacgtccatcgggctgatctgcgtgatcgccagctccggcatgctctggatggccgagatcccgctgcagtggatcgcgagcgccatcgtcctggagttcttcatgatggtgctcctgatccccgagcccgagaagcagcgcacgccccaggacaaccagctggcctacgtggtcatcgggatcctcaccctggccgccatcatcgcggccaacgagatgggcctgctcgagaccacgaagcgggacctgggcatgtccaaggagccgggggtggtgagccccacctcctacctggacgtcgacctccaccccgccagcgcctggaccctgtacgcggtggccaccacggtgatcacccccatgctgcgccacaccatcgagaactccaccgccaacgtcagcctcgccgccatcgcgaaccaggccgtggtgctgatgggcctggacaaggggtggccgatctccaagatggacctcggcgtccccctgctggccctcgggtgctacagccaggtgaaccccctgacgctgaccgccgccgtgctcctgctgatcacccactacgcgatcatcggccccggcctccaggccaaggccacccgggaggcccagaagcgcacggccgcggggatcatgaagaacccgaccgtcgacggcatcatgaccatcgacctggaccccgtgatctacgactccaagttcgagaagcagctgggccaggtgatgctcctggtcctgtgcgccgtgcagctcctgctgatgcggaccagctgggccctctgcgaggccctgacgctggcgaccggccccatcaccaccctctgggagggctcccccgggaagttctggaacacgaccatcgccgtgagcatggccaacatcttccgcggctcctacctggccggggccggcctggcgttcagcatcatgaagtccgtcgggaccggcaagcggggcaccgggagccagggcgagaccctcggggagaagtggaagaagaagctgaaccagctgagccgcaaggagttcgacctctacaagaagtccggcatcacggaggtggaccggaccgaggccaaggaggggctgaagcgcggcgagatcacccaccacgccgtgagccggggctccgccaagctgcagtggttcgtcgagcgcaacatggtgatcccggaggggcgggtgatcgacctcggctgcgggcgcggcgggtggagctactactgcgccggcctgaagaaggtcaccgaggtgcggggctacacgaagggcgggcccgggcacgaggagcccgtgcccatgtccacctacggctggaacatcgtcaagctgatgagcgggaaggacgtgttctacctgccgcccgagaagtgcgacaccctcctgtgcgacatcggcgagtccagcccctcccccaccgtggaggagagccgcacgatccgcgtcctgaagatggtggagccgtggctcaagaacaaccagttctgcatcaaggtgctgaacccctacatgcccaccgtcatcgagcacctggagcggctccagcgcaagcacggcgggatgctggtgcggaaccccctgtcccgcaacagcacccacgagatgtactggatctccaacggcaccgggaacatcgtgagctccgtcaacatggtgagccggctcctgctgaaccgcttcacgatgacccaccggcgcccgaccatcgagaaggacgtggacctcggcgcgggcacccggcacgtcaacgccgagcccgagacgcccaacatggacgtgatcggggagcgcatcaagcggatcaaggaggagcacaactccacctggcactacgacgacgagaacccgtacaagacctgggcctaccacggcagctacgaggtgaaggccaccgggtccgccagcagcatgatcaacggcgtcgtgaagctgctgacgaagccctgggacgtcgtgcccatggtgacccagatggcgatgaccgacaccacgcccttcgggcagcagcgcgtcttcaaggagaaggtggacacccggaccccgcgccccatgcccggcacccggaaggtgatgggcatcacggccgagtggctctggcgcaccctggggcggaacaagcgcccccggctgtgcacccgcgaggagttcaccaagaaggtccgcacgaacgccgccatgggcgcggtgttcaccgaggagaaccagtgggactccgccaaggccgccgtggaggacgaggagttctggaagctcgtcgaccgggagcgcgagctgcacaagctggggaagtgcggcagctgcgtgtacaacatgatggggaagcgggagaagaagctcggcgagttcggcaaggccaaggggtcccgcgcgatctggtacatgtggctgggcgcccggtacctggagttcgaggccctcgggttcctgaacgaggaccactggttcagccgcgacaactcctacagcggcgtggagggggagggcctgcacaagctcggctacatcctgcgggacatctccaagatccccggcggggccatgtacgccgacgacaccgcggggtgggacacccgcatcacggaggacgacctgcacaacgaggagaagatcacccagcagatggaccccgagcaccggcagctcgccaacgccatcttcaagctgacctaccagaacaaggtcgtgaaggtgcagcgccccacccccaccgggacggtcatggacatcatcagccggaaggaccagcgcggctccggccaggtgggcacctacgggctgaacaccttcaccaacatggaggtgcagctcgtccggcagatggagggcgagggggtgctgagcaaggccgacctggagaacccgcacctccccgagaagaagatcacgcagtggctggagaccaagggcgtggagcgcctgaagcggatggccatctccggcgacgactgcgtcgtgaagcccatcgacgaccgcttcgcgaacgccctcctggccctgaacgacatggggaaggtgcggaaggacatcccccagtggcagccgagcaagggctggcacgactggcagcaggtccccttctgctcccaccacttccacgagctcatcatgaaggacgggcgcaagctggtggtgccctgccggccccaggacgagctgatcggccgcgcccggatcagccagggggccggctggtccctccgcgagaccgcgtgcctgggcaaggcctacgcccagatgtggagcctgatgtacttccaccgccgggacctccgcctggcctccaacgcgatctgcagcgccgtcccggtgcactgggtgcccacctcccggacgacctggagcatccacgcccaccaccagtggatgaccaccgaggacatgctgacggtctggaaccgcgtgtggatcgaggacaacccctggatggaggacaagacccccgtgaccacctgggagaacgtcccgtacctcgggaagcgggaggaccagtggtgcggcagcctgatcgggctgacgtcccgcgccacctgggcccagaacatccccaccgcgatccagcaggtccggagcctcatcggcaacgaggagttcctggactacatgccctccatgaagcgcttccggaaggaggaggagagcgagggggccatctggtga

SEQ ID NO: 10373 - RNA, 9873 nt, synthetic construct
  misc_feature 1..9873: note = derived and/or modified CDS sequence (opt1) from DENV-3__KM190937__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacgtacgggacctgcaaccaggccggcgagcaccggcgcgacaagcggagcgtggccatcgcgccccacgtgggcatggggctcgacacccgcacccagacgtggatgagcgcggagggcgcctggcgccaggtggagaaggtggagacctgggccctgcgccaccccgggttcaccatcctggccctcttcctggcgcactacatcggcacctccctgacgcagaaggtggtgatcttcatcctcctgatgctggtcacccccagcatgaccatgcggtgcgtgggggtgggcaaccgcgacttcgtcgagggcctctccggggccacctgggtggacgtggtcctggagcacggcgggtgcgtgacgaccatggccaagaacaagcccaccctggacatcgagctccagaagaccgaggccacgcagctggccaccctgcggaagctctgcatcgagggcaagatcaccaacatcaccacggacagccgctgccccacccagggcgaggcgatcctgccggaggagcaggaccagaactacgtgtgcaagcacacctacgtcgaccgggggtggggcaacgggtgcggcctgttcgggaagggctccctcgtgacctgcgccaagttccagtgcctggagagcatcgagggcaaggtggtccagcacgagaacctgaagtacacggtgatcatcaccgtgcacaccggggaccagcaccaggtcggcaacgagatgcagggggtgaccgccgagatcacgccccaggcctccaccgccgaggtcatcctccccgagtacggcaccctggggctggagtgcagcccccgcaccggcctcgacttcaacgagatgatctccctgaccatgaagaacaaggcgtggatggtgcaccggcagtggttcttcgacctgccgctcccctggacgagcggcgccaccgccgagacccccacctggaaccgcaaggagctgctggtgacgttcaagaacgcccacgccaagaagcaggaggtcgtggtgctcgggtcccaggagggcgcgatgcacaccgccctgaccggggccaccgagatccagacgagcggcgggacctccatcttcgccggccacctgaagtgccggctcaagatggacaagctggagctgaagggcatgagctacgccatgtgcctcagctccttcgtcctgaagaaggaggtgagcgagacccagcacgggaccatcctgatcaaggtggagtacaagggcgaggacgcgccctgcaagatcccgttctccacggaggacgggcagggcaaggcccacaacggccgcctcatcaccgccaaccccgtcgtgaccaagaaggaggagcccgtgaacatcgaggccgagcccccgttcggggagagcaacatcgtcatcggcatcggggacaaggcgctgaagatcaactggtacaagaagggctccagcatcgggaagatgttcgaggccaccgcccggggcgcccgccggatggccatcctgggcgacacggcgtgggacttcgggtccgtgggcggggtgctgaacagcctcggcaagatggtccaccagatcttcgggtccgcctacaccgccctgttcggcggcgtgagctggatgatgaagatcgggatcggcgtgctgctcacctggatcgggctgaactccaagaacaccagcatgtccttcagctgcatcgccatcggcatcatcacgctgtacctcggggccgtcgtgcaggcggacatgggctgcgtgatcaactggaagggcaaggagctgaagtgcgggtccggcatcttcgtcaccaacgaggtgcacacctggaccgagcagtacaagttccaggccgacagccccaagcgcctggccacggccatcgccggggcgtgggagaacggcgtgtgcgggatccgctccaccacccggatggagaacctcctgtggaagcagatcgccaacgagctgaactacatcctctgggagaacaacatcaagctgaccgtcgtggtgggcgacatcacgggcgtcctggagcaggggaagcgcaccctcacgccccagcccatggagctgaagtacagctggaagacctggggcaaggccaagatcgtgacggccgagacccagaactccagcttcatcatcgacgggccgagcacccccgagtgcccctccgcgagccgggcctggaacgtgtgggaggtcgaggactacggcttcggcgtgttcaccacgaacatctggctgaagctccgcgaggtgtacacccagctgtgcgaccaccggctgatgtccgccgccgtcaaggacgagcgcgccgtgcacgcggacatggggtactggatcgagagccagaagaacggctcctggaagctcgagaaggccagcttcatcgaggtgaagacctgcacctggcccaagtcccacaccctgtggagcaacggggtcctggagtccgacatgatcatccccaagagcctcgccggccccatctcccagcacaaccaccggcccgggtaccacacgcagaccgccggcccgtggcacctgggcaagctggagctcgacttcaactactgcgaggggaccaccgtggtgatcagcgagaactgcggcacgcgcgggccctccctgcggaccaccaccgtcagcggcaagctgatccacgagtggtgctgccgctcctgcacgctgccgcccctccggtacatgggggaggacggctgctggtacggcatggagatccgcccgatcaacgagaaggaggagaacatggtcaagagcctggcctccgcggggagcggcaaggtggacaacttcaccatgggggtcctctgcctggccatcctgttcgaggaggtgatgcggggcaagttcgggaagatccacatgatcgccggcgtcctcttcaccttcgtcctgctgctcagcggccagatcacctggcgcgacatggcccacacgctgatcatgatcgggtccaacgccagcgaccggatgggcatgggggtgacctacctggcgctcatcgccaccttcaagatccagcccttcctggccctgggcttcttcctccgcaagctgacctcccgggagaacctgctcctgggcgtggggctggccatggcggccacgctccgcctgcccgaggacatcgagcagatggccaacggcatcgccctggggctcatggccctgaagctgatcacccagttcgagacctaccagctctggaccgcgctggtcagcctgacgtgctccaacaccatcttcaccctcaccgtggcctggcggacggccaccctgatcctggccggcatcagcctcctgcccgtgtgccagtccagctccatgcgcaagaccgactggctgccgatgaccgtcgccgcgatgggggcccagcccctccccctgttcatcttcagcctgaaggacacgctcaagcgccggtcctggcccctgaacgagggcgtgatggccgtcggcctggtgagcatcctcgcctccagcctgctgcgcaacgacgtgccgatggccgggcccctcgtcgcgggcgggctgctgatcgcctgctacgtgatcaccggcacctccgccgacctcaccgtggagaaggccgccgacgtcacgtgggaggaggaggcggagcagaccggggtgagccacaacctgatggtgaccgtcgacgacgacggcaccatgcggatcaaggacgacgagacggagaacatcctgaccgtgctcctgaagaccgccctgctcatcgtgtccggcatcttcccctacagcatccccgccaccctgctggtctggcacacctggcagaagcagacgcagcgctccggggtgctctgggacgtgccgtccccgcccgagacccagaaggccgagctggaggagggcgtctaccggatcaagcagcaggggatcttcggcaagacccaggtgggggtgggcgtccagaaggagggcgtgttccacaccatgtggcacgtgacgcgcggggcggtcctgacccacaacggcaagcggctcgagcccaactgggccagcgtgaagaaggacctgatctcctacgggggcgggtggcgcctgagcgcccagtggcagaagggcgaggaggtgcaggtcatcgccgtggagccgggcaagaaccccaagaacttccagaccatgcccgggatcttccagaccacgaccggcgagatcggggccatcgcgctcgacttcaagcccggcacctccggcagcccgatcatcaaccgggaggggaaggtggtcggcctgtacgggaacggcgtggtgaccaagaacgggggctacgtctccggcatcgcccagacgaacgccgagcccgacgggcccaccccggagctggaggaggagatgttcaagaagcgcaacctgaccatcatggacctccaccccggcagcgggaagacccggaagtacctgcccgccatcgtgcgcgaggccatcaagcggcgcctgcggacgctcatcctggcgcccacccgcgtggtcgccgccgagatggaggaggccctgaagggcctcccgatccggtaccagaccaccgccacgaagtccgagcacaccgggcgcgagatcgtggacctgatgtgccacgcgaccttcaccatgcggctgctcagccccgtgcgcgtccccaactacaacctgatcatcatggacgaggcccacttcacggaccccgcctccatcgccgcgcggggctacatcagcacccgcgtgggcatgggggaggccgccgccatcttcatgaccgccaccccgcccggcacggcggacgccttcccccagtccaacgcccccatccaggacgaggagcgcgacatcccggagcggagctggaactccgggaacgagtggatcaccgacttcgtgggcaagaccgtctggttcgtgcccagcatcaaggccgggaacgacatcgccaactgcctgcgcaagaacggcaagaaggtgatccagctctcccggaagaccttcgacacggagtaccagaagaccaagctgaacgactgggacttcgtcgtgaccaccgacatcagcgagatgggcgcgaacttcaaggccgaccgcgtgatcgacccccggcgctgcctgaagcccgtcatcctcacggacgggccggagcgggtgatcctggccggccccatgcccgtgaccgtcgcctccgccgcgcagcgccgggggcgcgtgggccggaacccccagaaggagaacgaccagtacatcttcatggggcagccgctgaacaacgacgaggaccacgcccactggaccgaggccaagatgctcctggacaacatcaacacccccgagggcatcatccccgccctgttcgagcccgagcgcgagaagtccgcggccatcgacggcgagtaccggctcaagggggagtcccgcaagacgttcgtggagctgatgcggcgcggcgacctgccggtctggctcgcccacaaggtggccagcgaggggatcaagtacaccgaccggaagtggtgcttcgacggcgagcgcaacaaccagatcctggaggagaacatggacgtcgagatctggaccaaggagggcgagaagaagaagctgcggccccgctggctcgacgcccgcacctacagcgaccccctggcgctgaaggagttcaaggacttcgccgccgggcggaagtccatcgccctcgacctggtgaccgagatcggccgcgtgcccagccacctggcccaccggacgcgcaacgcgctcgacaacctggtcatgctgcacacctccgagcacgggggccgggcctaccgccacgccgtggaggagctcccggagaccatggagaccctgctgctcctggggctgatgatcctcctgacgggcggcgccatgctgttcctcatcagcgggaagggcatcgggaagacctccatcggcctgatctgcgtgatcgccagctccgggatgctgtggatggcggacgtccccctccagtggatcgccagcgccatcgtgctggagttcttcatgatggtgctgctcatccccgagccggagaagcagcggacgccccaggacaaccagctggcctacgtcgtgatcggcatcctgaccctcgccgcgatcgtggccgccaacgagatgggcctgctggagacgaccaagcgcgacctcgggatgtccaaggagcccggcgtcgtgagccccacctcctacctggacgtggacctgcacccggccagcgcgtggaccctctacgccgtcgccacgaccgtgatcacccccatgctgcggcacaccatcgagaactccacggccaacgtgagcctggccgcgatcgccaaccaggccgtcgtgctcatggggctggacaagggctggcccatctccaagatggacctgggggtgcccctcctggccctgggctgctacagccaggtcaacccgctcaccctggccgcggccgtgctgctcctggtgacccactacgccatcatcggccccgggctgcaggccaaggccacccgcgaggcgcagaagcggacggccgccggcatcatgaagaaccccaccgtcgacgggatcatgaccatcgacctcgaccccgtgatctacgactccaagttcgagaagcagctgggccaggtgatgctgctcgtcctgtgcgccgtgcagctgctcctgatgcgcaccagctgggcgctgtgcgaggtgctcacgctggccaccggcccgatcaccaccctgtgggaggggtcccccggcaagttctggaacacgaccatcgccgtcagcatggccaacatcttccgggggagctacctcgccggcgcggggctggccttctccatcatgaagtccgtgggcaccggcaagcgcgggaccggctcccagggggagacgctgggcgagaagtggaagaagaagctcaaccagctgagccggaaggagttcgacctgtacaagaagtccgggatcaccgaggtggaccgcaccgaggccaaggagggcctcaagcggggcgagatcacccaccacgccgtcagccgcgggtccgccaagctgcagtggttcgtggagcggaacatggtgatccccgagggccgcgtcatcgacctggggtgcggccgcggcgggtggagctactactgcgcggggctcaagaaggtgacggaggtgcgcgggtacaccaagggcgggcccggccacgaggagccggtccccatgtccacctacgggtggaacatcgtgaagctgatgagcggcaaggacgtgttctacctgccgcccgagaagtgcgacaccctcctgtgcgacatcggcgagtccagcccgtcccccaccgtcgaggagagccgcacgatccgggtgctgaagatggtggagccctggctgaagaacaaccagttctgcatcaaggtcctcaacccctacatgccgaccgtgatcgagcacctggagcgcctgcagcggaagcacgggggcatgctcgtgcgcaaccccctgtcccggaacagcacccacgagatgtactggatctccaacgggaccggcaacatcgtcagctccgtgaacatggtgagccgcctgctcctgaaccggttcacgatgacccaccgccggcccaccatcgagaaggacgtcgacctgggcgccgggacccgccacgtgaacgccgagcccgagacgccgaacatggacgtcatcggcgagcggatcaagcgcatcaaggaggagcacagctccacctggcactacgacgacgagaacccctacaagacctgggcctaccacgggagctacgaggtgaaggccaccggctccgcgagctccatgatcaacggggtggtcaagctcctgacgaagccctgggacgtggtgccgatggtcacccagatggccatgaccgacaccacgcccttcggccagcagcgggtgttcaaggagaaggtggacacccgcacgccccggcccatgccgggcacccgcaaggtcatggagatcaccgccgagtggctgtggcggaccctcgggcgcaacaagcggccccgcctgtgcacccgcgaggagttcaccaagaaggtgcggacgaacgccgcgatgggcgccgtgttcaccgaggagaaccagtgggacagcgcccgcgccgccgtcgaggacgaggagttctggaagctggtggaccgggagcgcgagctccacaagctggggaagtgcggctcctgcgtgtacaacatgatggggaagcgggagaagaagctgggcgagttcggcaaggcgaaggggagccgcgccatctggtacatgtggctcggcgcccggtacctggagttcgaggccctggggttcctcaacgaggaccactggttctcccgcgagaacagctactccggcgtcgagggggagggcctgcacaagctgggctacatcctccgggacatcagcaagatccccgggggcgccatgtacgcggacgacaccgccgggtgggacacccgcatcacggaggacgacctgcacaacgaggagaagatcacccagcagatggaccccgagcaccggcagctggccaacgccatcttcaagctcacctaccagaacaaggtggtgaaggtccagcgcccgacccccaagggcacggtgatggacatcatctcccggaaggaccagcgcggcagcggccaggtgggcacctacgggctgaacaccttcaccaacatggaggcccagctgatccggcagatggagggcgagggggtcctctccaaggcggacctggagaacccccaccccctggagaagaagatcacgcagtggctcgagaccaagggcgtggagcgcctgaagcggatggccatcagcggcgacgactgcgtggtcaagccgatcgacgaccgcttcgccaacgccctgctcgccctgaacgacatggggaaggtgcggaaggacatcccccagtggcagccctccaagggctggcacgactggcagcaggtccccttctgcagccaccacttccacgagctgatcatgaaggacgggcgcaagctcgtcgtgccgtgccggccccaggacgagctgatcggccgcgcgcgcatctcccagggggccggctggagcctgcgggagaccgcctgcctcggcaaggcctacgcgcagatgtgggccctgatgtacttccaccgccgggacctgcgcctcgccagcaacgccatctgctccgccgtgcccgtccactgggtgcccaccagccggaccacgtggtccatccacgcgcaccaccagtggatgaccaccgaggacatgctgaccgtgtggaaccgcgtctggatcgaggacaacccgtggatggaggacaagacgcccgtgaccacctgggaggacgtgccctacctggggaagcgggaggaccagtggtgcggcagcctcatcgggctgacctcccgcgccacgtgggcccagaacatcctgaccgccatccagcaggtccggagcctcatcggcaacgaggagttcctggactacatgccctccatgaagcgcttccggaaggaggaggagagcgagggggccatctggtga

SEQ ID NO: 10374 - RNA, 9873 nt, synthetic construct
  misc_feature 1..9873: note = derived and/or modified CDS sequence (opt1) from DENV-3__JQ920487__SS-prME
  source 1..9873: mol_type = other RNA
accagcctgtgcctcatgatgatgctgcccgccaccctggccttccacctcaccagccgggacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccgtcgtggtgggggacgtcatcggcgtgctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtctgggaggtggaggactacgggttcggcgtgttcacgaccaacatctggctgaagctgcgggagatgtacacccagctctgcgaccaccgcctgatgagcgccgccgtcaaggacgagcgggccgtgcacgcggacatgggctactggatcgagtcccagaagaacgggagctggaagctggagaaggcctccctcatcgaggtgaagacctgcacctggcccaagagccacacgctgtggtccaacggcgtcctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtggtgatcaccgagaactgcgggacccggggcccctccctgcgcaccacgaccgtcagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtcctctgcctggccatcctgttcgaggaggtgatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtcacctacctggccctcatcgccacgttcaagatccagcccttcctggccctggggttcttcctccggaagctgaccagccgcgagaacctgctcctgggcgtgggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcttcacgctcaccgtcgcctggcggaccgccaccctgatcctggccgtgatcagcctcctgcccgtgtgccagtccagctccatgcgcaagacggactggctgccgatgaccgtcgccgcgatgggggtgccgcccctccccctgttcatcttcagcctgaaggacaccctcaagcggcgctcctggccgctgaacgagggcgtcatggccgtggggctggtgagcatcctcgcctccagcttcctgcgcaacgacgtccccatggccggccccctggtggccggcgggctcctgatcgcgtgctacgtgatcaccggcacgtccgccgacctgaccgtcgagaaggccgccgacgtgacctgggaggaggaggccgagcagaccggggtgagccacaacctcatgatcacggtcgacgacgacggcaccatgcggatcaaggacgacgagaccgagaacatcctgaccgtgctgctcaagaccgcgctgctgatcgtgtccgggatcttcccctacagcatcccggccacgctcctggtctggcacacctggcagaagcagacccagcgctccggcgtgctgtgggacgtgccctccccgcccgagacccagaaggccgagctcgaggagggcgtctaccggatcaagcagcaggggatcttcggcaagacccaggtgggggtgggcgtccagaaggagggggtgttccacaccatgtggcacgtgacccgcggcgccgtcctgacccacaacggcaagcggctggagccgaactgggcgaacgtgaagaaggacctcatctcctacgggggcgggtggaagctgagcgcccagtggcagaagggcgaggaggtgcaggtcatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtggtcggcctgtacgggaacggcgtggtgaccaagaacgggggctacgtcagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtggtcgcggccgagatggaggaggccctgaagggcctgcccatccgctaccagacgaccgccaccaagagcgagcacaccgggcgggagatcgtggacctcatgtgccacgccacgttcaccatgcgcctgctgtcccccgtgcgggtccccaactacaacctcatcgtgatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtctggttcgtgccctccatcaaggccgggaacgacatcgccaactgcctgcgcaagaacggcaagaaggtgatccagctgagccgcaagaccttcgacaccgagtaccagaagaccaagctcaacgactgggacttcgtcgtgacgaccgacatctccgagatgggggcgaacttcaaggccgaccgggtgatcgacccccgccggtgcctgaagccggtcatcctgaccgacggccccgagcgcgtgatcctcgccggccccatgcccgtgaccgtcgccagcgccgcgcagcggcgcgggcgggtgggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtctggctggcccacaaggtggcctccgaggggatcaagtacaccgaccgcaagtggtgcttcgacggcgagcggaacaaccagatcctcgaggagaacatggacgtcgagatctggacgaaggagggggagaagaagaagctgcgcccccggtggctggacgcccgcacctacagcgaccccctcgcgctgaaggagttcaaggacttcgccgccggccggaagtccatcgccctggacctcgtgaccgagatcggccgcgtgccgagccacctggcccaccgcacccggaacgcgctggacaacctcgtcatgctgcacacgtccgagcacgggggccgcgcctaccggcacgccgtggaggagctgcccgagaccatggagaccctcctgctgctcgggctgatgatcctgctcaccggcggggccatgctgttcctgatcagcggcaagggcatcgggaagacgagcatcggcctcatctgcgtggtcgcctccagcgggatgctgtggatggcggacgtgcccctgcagtggatcgcctccgccatcgtgctcgagttcttcatgatggtcctgctgatcccggagcccgagaagcagcgcacgccccaggacaaccagctcgcctacgtggtgatcggcatcctgaccctggccgcgatcgtcgccgccaacgagatggggctcctggagaccacgaagcgggacctgggcatgagcaaggagcccggcgtggtgtccccgaccagctacctcgacgtcgacctgcaccccgcctccgcgtggaccctgtacgccgtggccaccacggtgatcacccccatgctccgccacaccatcgagaacagcaccgccaacgtctccctggccgcgatcgccaaccaggccgtggtgctgatggggctcgacaagggctggcccatcagcaagatggacctgggggtcccgctgctcgccctgggctgctactcccaggtgaaccccctgacgctcaccgccgcggtgctgctgctcgtcacccactacgccatcatcgggcccggcctgcaggccaaggccacccgggaggcccagaagcgcacggcggccggcatcatgaagaaccccaccgtggacgggatcatgaccatcgacctggacccggtgatctacgacagcaagttcgagaagcagctcggccaggtcatgctgctggtgctctgcgccgtgcagctgctgctcatgcggacctcctgggccttctgcgaggcgctgacgctggccaccgggcccatcaccaccctctgggagggcagccccggcaagttctggaacacgaccatcgccgtctccatggccaacatcttccgcgggagctacctggccggcgcggggctggccttctccatcatgaagtccgtgggcaccgggaagcggggcaccggctcccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtctcccggggcagcgccaagctgcagtggttcgtggagcgcaacatggtgatccccgagggccgggtcatcgacctcgggtgcggccgcgggggctggtcctactactgcgcggggctgaagaaggtgaccgaggtgcggggctacacgaagggcgggccgggccacgaggagcccgtccccatgagcacctacgggtggaacatcgtgaagctgatgtccggcaaggacgtgttctacctcccgcccgagaagtgcgacaccctgctgtgcgacatcggggagagctcccccagccccaccgtcgaggagtcccgcacgatccgggtgctgaagatggtggagccctggctcaagaacaaccagttctgcatcaaggtcctgaacccctacatgcccaccgtgatcgagcacctggagcgcctccagcgcaagcacggcggcatgctggtgcggaaccccctgagccgcaactccacccacgagatgtactggatcagcaacgggaccggcaacatcgtctccagcgtgaacatggtgtcccggctcctgctgaaccgcttcacgatgacccaccggcgccccaccatcgagaaggacgtcgacctcggggccggcacccggcacgtgaacgccgagccggagacgcccaacatggacgtcatcggcgagcgcatccggcgcatcaaggaggagcacagctccacctggcactacgacgacgagaacccctacaagacctgggcctaccacgggagctacgaggtgaaggccaccggctccgcgagcagcatgatcaacggggtggtcaagctgctgacgaagccgtgggacgtggtgcccatggtcacccagatggccatgaccgacaccacgcccttcggccagcagcgggtgttcaaggagaaggtggacacccgcacgccccggccgatgcccgggacccgcaaggtcatggagatcacggccgagtggctctggcggaccctgggccgcaacaagcggccccgcctgtgcacccgggaggagttcatcaagaaggtgcgcaccaacgccgcgatgggcgccgtgttcacggaggagaaccagtgggactccgcccgcgccgccgtcgaggacgaggagttctggaagctcgtggaccgggagcgcgagctgcacaagctggggaagtgcggcagctgcgtgtacaacatgatggggaagcgggagaagaagctcggcgagttcgggaaggcgaagggctcccgcgccatctggtacatgtggctgggcgcccggtacctggagttcgaggccctcgggttcctgaacgaggaccactggttcagccgcgagaactcccacagcggcgtcgagggggagggcctgcacaagctcgggtacatcctgcgggacatctccaagatccccggcggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaagggcaccgtgatggacatcatcagccggaaggaccagcgcgggtccggccaggtgggcacgtacgggctgaacaccttcaccaacatggaggcccagctcatccggcagatggagggcgagggggtcctgagcaaggcggacctggagaacccccacctcctggagaagaaggtgacccagtggctggagaccaagggcgtggagcgcctcaagcggatggccatctccggggacgactgcgtcgtgaagccgatcgacgaccgcttcgccaacgccctgctggccctcaacgacatgggcaaggtgcggaaggacatcccccagtggcagcccagcaagggctggcacgactggcagcaggtccccttctgctcccaccacttccacgagctgatcatgaaggacgggcgcaagctggtggtgccgtgccggccccaggacgagctcatcggccgcgcgcggatcagccagggggccggctggtccctgcgcgagacggcctgcctggggaaggcctacgcgcagatgtgggccctcatgtacttccaccgccgggacctgcgcctggccagcaacgccatctgctccgccgtccccgtgcactgggtgcccaccagccggaccacctggtccatccacgcgcaccaccagtggatgacgaccgaggacatgctcaccgtctggaaccgcgtgtggatcgaggacaacccgtggatggaggacaagacccccgtgacgacctgggaggacgtcccctacctgggcaagcgggaggaccagtggtgcggcagcctgatcgggctcaccagccgcgccacctgggcccagaacatcctgacggccatccagcaggtccggtccctgatcggcaacgaggagttcctcgactacatgcccagcatgaagcgcttccggaaggaggaggagtccgagggggccatctggtga

SEQ ID NO: 10375 - RNA, 9873 nt, synthetic construct
  misc_feature 1..9873: note = derived and/or modified CDS sequence (opt1) from DENV-3__JQ920488__SS-prME
  source 1..9873: mol_type = other RNA
accagcctgtgcctgatgatgatgctgcccgccaccctggccttccacctcaccagccgggacggcgagccccggatgatcgtggggaagaacgagcggggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacgtggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgctgcgcgcctggaacgtgtgggaggtcgaggactacgggttcggcgtgttcacgaccaacatctggctgaagctccgggagaagtacacccagctgtgcgaccaccgcctgatgagcgccgccgtgaaggacgagcgggccgtccacgcggacatgggctactggatcgagagccagaagaacgagtcctggaagctcgagaaggccagcctgatcgaggtgaagacctgcacctggcccaagtcccacacgctgtggagcaacggggtgctcgagtccgacatgatcatccccaagagcctggccggccccatctcccagcacaactaccgccccgggtaccacacccagaccgccggcccgtggcacctggggaagctcgagctggacttcaactactgcgagggcaccacggtcgtgatcaccgagaactgcggcatccgggggcccagcctgcgcaccaccacggtgtccggcaagctcatccacgagtggtgctgccggagctgcaccctgccgcccctgcgctacatgggggaggacggctgctggtacgggatggagatccggccgatcaacgagaaggaggagaacatggtcaagtccctcgtgagcgccggctccggcaagaccgacaacttcaccatgggggtgctgtgcctggcgatcctcttcgaggaggtcatgcgcggcaagttcgggaagaagcacatgatcgccggcgccctgttcacgttcgtgctgctcctgagcgggcagatcacctggcgggacatggcccacaccctgatcatgatcggctccaacgccagcgaccgcatgggcatgggggtgacctacctcgcgctgatcgccacgttcaagatccagcccttcctggccctcggcttcttcctgcggaagctgacctcccgcgagaacctcctgctgggggtcggcctcgccatggcgaccaccctgcagctgcccgaggacatcgagcagatggccaacggcatcgccctcgggctgatggccctgaagctcatcacgcagttcgagacctaccagctgtggaccgccctgatcagcctcatgtgcagcaacaccatcttcacgctgaccgtggcgtggcggaccgccaccctgatcctcgccgtgatctccctgctgcccgtctgccagagctccagcatgcgcaagacggactggctcccgatgaccgtggccgccatgggcgtgccgcccctgcccctgttcatcttctccctcaaggacaccctgaagcggcgcagctggccgctgaacgagggggtcatggcggtgggcctcgtctccatcctggccagctccttcctgcgcaacgacgtgcccatggccgggcccctcgtggccggcggcctgctgatcgcctgctacgtcatcaccgggacgagcgcggacctcaccgtggagaaggccgccgacgtgacctgggaggaggaggccgagcagaccggcgtctcccacaacctgatgatcacggtggacgacgacgggaccatgcggatcaaggacgacgagaccgagaacatcctgaccgtgctcctgaagaccgccctgctcatcgtcagcggcatcttcccctactccatcccggcgacgctgctggtgtggcacacctggcagaagcagacccagcgcagcggggtgctctgggacgtccccagcccgcccgagacccagaaggccgagctggaggagggcgtgtaccggatcaagcagcagggcatcttcgggaagacccaggtgggcgtcggggtgcagaaggagggcgtgttccacaccatgtggcacgtcacccgcggggccgtgctgacccacaacggcaagcggctcgagccgaactgggccaacgtgaagaaggacctgatcagctacggcgggggctggaagctgggggcgcagtggcagaagggcgaggaggtccaggtgatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtcgtgggcctctacgggaacggcgtggtcaccaagaacgggggctacgtgtccgggatcgcccagaccaacgcggagcccgacggcccgacccccgagctggaggaggagatgttcaagaagcggaacctgacgatcatggacctccaccccggcagcgggaagacccgcaagtacctgcccgccatcgtgcgggaggccatcaagcgccggctgcgcaccctcatcctggccccgacccgggtcgtggccgcggagatggaggaggccctgaagggcctccccatccgctaccagacgaccgccaccaagagcgagcacaccgggcgggagatcgtggacctgatgtgccacgccacgttcaccatgcgcctgctctcccccgtccgggtgcccaactacaacctgatcgtgatggacgaggcccacttcaccgacccggcgagcatcgccgcccgcggctacatctccacccgggtcgggatgggcgaggccgcggccatcttcatgacggccacgccgcccggcaccgccgacgccttcccccagagcaacgcgccgatccaggacgaggagcgcgacatccccgagcggtcctggaacagcgggaacgagtggatcaccgacttcgccggcaagacggtgtggttcgtgccctccatcaaggccgggaacgacatcgccaactgcctgcgcaagaacggcaagaaggtcatccagctcagccgcaagaccttcgacaccgagtaccagaagaccaagctgaacgactgggacttcgtggtgacgaccgacatctccgagatgggggccaacttcaaggcggaccgggtcatcgacccccgccggtgcctgaagccggtgatcctcaccgacggccccgagcgcgtgatcctggccggccccatgcccgtcaccgtggccagcgccgcccagcggcgcgggcgggtgggccgcaactcccagaaggagaacgaccagtacatcttcacggggcagccgctgaacaacgacgaggaccacgcgcactggaccgaggccaagatgctcctggacaacatcaacacccccgagggcatcatccccgccctgttcgagcccgagcgggagaagtccgccgcgatcgacggggagtaccgcctcaagggcgagtcccggaagaccttcgtcgagctgatgcgccggggcgacctgccggtgtggctcgcccacaaggtggccagcgaggggatcaagtacaccgaccgcaagtggtgcttcgacggcgagcggaacaaccagatcctggaggagaacatggacgtcgagatctggacgaaggagggggagaagaagaagctgcgcccccggtggctcgacgcccgcacctactccgaccccctggccctgaaggagttcaaggacttcgcggccggccgcaagagcatcgccctcgacctggtgaccgagatcggccgcgtcccctcccacctggcccaccgcacccggaacgccctcgacaacctggtgatgctgcacacgagcgagcacgggggccgcgcgtaccggcacgccgtggaggagctcccggagaccatggagaccctgctgctcctggggctgatgatcctcctgaccggcggggccatgctgttcctcatctccggcaagggcatcgggaagacgagcatcggcctgatctgcgtcgtggccagctccgggatgctgtggatggccgacgtgcccctccagtggatcgcgagcgccatcgtcctggagttcttcatgatggtgctgctcatccccgagccggagaagcagcgcacgccccaggacaaccagctggcctacgtggtcatcggcatcctgaccctcgccgccatcgtggcggccaacgagatggggctgctggagaccacgaagcgggacctcggcatgtccaaggagcccggcgtggtcagccccacctcctacctggacgtggacctgcacccggccagcgcctggaccctctacgcggtggccaccacggtcatcacccccatgctgcgccacaccatcgagaactccaccgccaacgtgagcctggccgccatcgcgaaccaggccgtggtcctcatggggctggacaagggctggcccatctccaagatggacctgggggtgcccctcctggccctgggctgctacagccaggtgaacccgctcacgctgaccgccgccgtcctgctcctggtgacccactacgcgatcatcgggcccggcctgcaggccaaggccacccgggaggcccagaagcgcacggccgcgggcatcatgaagaaccccaccgtggacgggatcatgaccatcgacctcgaccccgtcatctacgactccaagttcgagaagcagctgggccaggtgatgctgctcgtgctgtgcgccgtccagctgctcctgatgcggaccagctgggccttctgcgaggccctgacgctcgcgaccgggccgatcaccaccctgtgggagggctcccccggcaagttctggaacacgaccatcgccgtgagcatggccaacatcttccgcgggtcctacctggccggcgccgggctcgcgttcagcatcatgaagtccgtgggcaccgggaagcggggcaccggcagccagggggagacgctgggcgagaagtggaagaagaagctgaaccagctctcccgcaaggagttcgacctgtacaagaagtccgggatcaccgaggtcgaccggaccgaggccaaggagggcctgaagcgcggggagatcacccaccacgccgtgagccggggctccgccaagctccagtggttcgtggagcgcaacatggtcatccccgagggccgggtgatcgacctggggtgcggccgcgggggctggagctactactgcgccgggctgaagaaggtgaccgaggtccggggctacacgaagggcgggcccggccacgaggagccggtgcccatgtccacctacgggtggaacatcgtgaagctcatgagcggcaaggacgtcttctacctgccgcccgagaagtgcgacaccctgctgtgcgacatcggggagtccagcccgtcccccaccgtggaggagagccgcacgatccgggtgctcaagatggtcgagccctggctgaagaacaaccagttctgcatcaaggtgctgaacccctacatgccgaccgtgatcgagcacctcgagcgcctgcagcgcaagcacggcggcatgctggtccggaaccccctctcccgcaacagcacccacgagatgtactggatctccaacgggaccggcaacatcgtgagctccgtgaacatggtcagccggctgctgctcaaccgcttcacgatgacccaccggcgccccaccatcgagaaggacgtggacctgggggcgggcacccggcacgtgaacgccgagcccgagacgccgaacatggacgtcatcggcgagcgcatccggcgcatcaaggaggagcactccagcacctggcactacgacgacgagaacccctacaagacctgggcctaccacgggtcctacgaggtgaaggccaccggcagcgcctccagcatgatcaacggggtcgtgaagctgctcacgaagccctgggacgtggtcccgatggtgacccagatggcgatgaccgacaccacgcccttcggccagcagcgggtgttcaaggagaaggtcgacacccgcacgccccggcccatgccggggacccgcaaggtgatggagatcaccgccgagtggctgtggcggaccctgggccgcaacaagcggccccgcctctgcacccgggaggagttcatcaagaaggtgcgcaccaacgccgccatgggcgcggtcttcacggaggagaaccagtgggacagcgcccgcgccgccgtggaggacgaggagttctggaagctggtggaccgggagcgcgagctgcacaagctcgggaagtgcggctcctgcgtctacaacatgatggggaagcgggagaagaagctgggcgagttcgggaaggccaagggcagccgcgcgatctggtacatgtggctgggcgcccggtacctcgagttcgaggccctggggttcctgaacgaggaccactggttctcccgcgagaacagccactccggcgtggagggggagggcctccacaagctggggtacatcctgcgggacatcagcaagatccccggcggcgccatgtacgccgacgacaccgcggggtgggacacccgcatcaccgaggacgacctccacaacgaggagaagatcacgcagcagatggaccccgagcaccggcagctggccaacgccatcttcaagctgacctaccagaacaaggtggtcaaggtgcagcgcccgacccccaagggcaccgtgatggacatcatctcccggaaggaccagcgcgggagcggccaggtcggcacgtacgggctcaacaccttcaccaacatggaggcccagctgatccggcagatggagggcgagggggtgctgtccaaggccgacctcgagaacccccacctcctggagaagaaggtgacccagtggctcgagaccaagggcgtcgagcgcctgaagcggatggcgatcagcggggacgactgcgtggtgaagcccatcgacgaccgcttcgccaacgccctgctcgccctgaacgacatgggcaaggtccggaaggacatcccgcagtggcagccctccaagggctggcacgactggcagcaggtccccttctgcagccaccacttccacgagctgatcatgaaggacgggcgcaagctcgtggtcccctgccggccgcaggacgagctgatcggccgcgcccggatctcccagggggcgggctggagcctgcgcgagacggcctgcctcgggaaggcctacgcccagatgtgggcgctgatgtacttccaccgccgggacctgcgcctcgcctccaacgccatctgcagcgccgtgcccgtgcactgggtccccacctcccggaccacctggagcatccacgcccaccaccagtggatgacgaccgaggacatgctgaccgtgtggaaccgcgtgtggatcgaggacaacccctggatggaggacaagaccccggtcacgacctgggaggacgtgccctacctgggcaagcgggaggaccagtggtgcggctccctcatcgggctgaccagccgcgcgacctgggcccagaacatcctgacggccatccagcaggtccggagcctcatcggcaacgaggagttcctggactacatgccctccatgaagcgcttccggaaggaggaggagagcgagggggccatctggtga

SEQ ID NO: 10376 - RNA, 9873 nt, synthetic construct
  misc_feature 1..9873: note = derived and/or modified CDS sequence (opt1) from DENV-3__JQ920489__SS-prME
  source 1..9873: mol_type = other RNA
accagcctctgcctcatgatgatgctgcccgccaccctggccttccacctcaccagccgggacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacatcaccacggacagccgctgccccacccagggcgaggcgatcctgcccgaggagcaggaccagaactacgtgtgcaagcacacctacgtcgaccgggggtggggcaacgggtgcggcctcttcgggaagggctccctggtgacctgcgccaagttccagtgcctggagagcatcgagggcaaggccgtgcagcacgagaacctcaagtacacggtcatcatcaccgtgcacaccggggaccagcaccaggtgggcaacgagacccagggggtcacggccgagatcacgccccaggcctccaccgtggaggcgatcctgcccgagtacggcaccctggggctcgagtgcagcccccgcaccggcctggacttcaacgagatgatcctgctcacgatgaagaacaaggcctggatggtccaccggcagtggttcttcgacctgccgctgccctggacctccggcgccaccaccgagacgcccacctggaacaagaaggagctcctggtgaccttcaagaacgcccacgccaagaagcaggaggtggtcgtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtgctcaagaaggaggtcagcgagacgcagcacgggaccatcctgatcaaggtggagtacaagggcgaggacgccccctgcaagatccccttcagcaccgaggacgggcagggcaaggcccacaacggccggctgatcaccgccaaccccatcgtgacgaagaaggaggagcccgtcaacatcgaggcggagccgcccttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtgggcggggtcctgaactccctgggcaagatggtgcaccagatcttcgggagcgcctacaccgccctcttctccggcgtgagctggatcatgaagatcggcatcggggtcctgctgacgtggatcggcctcaactccaagaacaccagcatgtccttcagctgcatcgtgatcgggatcatcaccctgtacctgggcgccgtggtccaggcggacatggggtgcgtgatcaactggaagggcaaggagctcaagtgcggctccgggatcttcgtgaccaacgaggtccacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtggtcggggacgtgatcggcgtgctggagcagggcaagcggaccctgacgccccagcccatggagctcaagtacagctggaagacgtgggggaaggccaagatcgtcaccgccgagacccagaactccagcttcatcatcgacggccccaacacccccgagtgcccctccgcgagccgcgcctggaacgtgtgggaggtggaggactacgggttcggcgtcttcacgaccaacatctggctgaagctgcgggagaagtacacccagctctgcgaccaccgcctgatgagcgccgccgtgaaggacgagcgggccgtgcacgcggacatgggctactggatcgagtcccagaagaacgggagctggaagctggagaaggcctccctcatcgaggtcaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtggtcatcaccgagaactgcgggatccggggcccctccctgcgcaccaccacggtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtctccgccggcagcgggaagaccgacaacttcaccatgggcgtgctctgcctggcgatcctgttcgaggaggtgatgcgcgggaagttcggcaagaagcacatgatcgccggggccctcttcacgttcgtcctgctgctctccggccagatcacctggcgggacatggcccacaccctgatcatgatcggcagcaacgcctccgaccgcatggggatgggcgtgacctacctggcgctcatcgccacgttcaagatccagcccttcctggccctggggttcttcctccggaagctgaccagccgcgagaacctgctcctgggcgtgggcctggccatggcgaccaccctccagctgcccgaggacatcgagcagatggccaacgggatcgccctgggcctcatggccctgaagctgatcacgcagttcgagacctaccagctctggaccgccctgatcagcctgatgtgctccaacaccatcttcacgctcaccgtcgcgtggcggaccgccaccctgatcctggccgtgatcagcctcctgcccgtgtgccagtccagctccatgcgcaagacggactggctgccgatgaccgtcgccgccatgggggtgccgcccctccccctgttcatcttcagcctgaaggacaccctcaagcggcgctcctggccgctgaacgagggcgtgatggcggtcgggctggtgagcatcctcgcctccagcttcctgcgcaacgacgtccccatggccggccccctggtggccggcgggctcctgatcgcctgctacgtgatcaccggcacgtccgcggacctgaccgtcgagaaggccgccgacgtgacctgggaggaggaggccgagcagaccggggtgagccacaacctcatgatcacggtcgacgacgacggcaccatgcggatcaaggacgacgagaccgagaacatcctgaccgtgctgctcaagaccgccctgctgatcgtgtccgggatcttcccctacagcatcccggcgacgctcctggtctggcacacctggcagaagcagacccagcgctccggcgtgctgtgggacgtgccctccccgcccgagacccagaaggccgagctcgaggagggcgtctaccggatcaagcagcaggggatcttcggcaagacccaggtgggggtgggcgtccagaaggagggggtgttccacaccatgtggcacgtgacccgcggcgccgtcctgacccacaacggcaagcggctggagccgaactgggccaacgtgaagaaggacctcatctcctacgggggcgggtggaagctgagcgcgcagtggcagaagggcgaggaggtgcaggtcatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtggtcggcctgtacgggaacggcgtggtgaccaagaacgggggctacgtcagcgggatcgcccagaccaacgcggagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtggtcgccgcggagatggaggaggccctgaagggcctgcccatccgctaccagacgaccgccaccaagagcgagcacaccgggcgggagatcgtggacctcatgtgccacgccacgttcaccatgcgcctgctgtcccccgtgcgggtccccaactacaacctcatcgtgatggacgaggcccacttcaccgacccggcgagcatcgccgcccgcggctacatctccacccgggtggggatgggcgaggccgcggccatcttcatgacggccacgccgcccggcaccgccgacgccttcccccagagcaacgcgccgatccaggacgaggagcgcgacatccccgagcggtcctggaacagcgggaacgagtggatcaccgacttcgccggcaagacggtctggttcgtgccctccatcaaggccgggaacgacatcgccaactgcctgcgcaagaacggcaagaaggtgatccagctgagccgcaagaccttcgacaccgagtaccagaagaccaagctcaacgactgggacttcgtcgtgacgaccgacatctccgagatgggggccaacttcaaggcggaccgggtgatcgacccccgccggtgcctgaagccggtcatcctgaccgacggccccgagcgcgtgatcctcgccggccccatgcccgtgaccgtcgccagcgccgcccagcggcgcgggcgggtgggccgcaactcccagaaggagaacgaccagtacatcttcacggggcagccgctgaacaacgacgaggaccacgcgcactggaccgaggccaagatgctgctcgacaacatcaacacccccgagggcatcatccccgccctgttcgagcccgagcgggagaagtccgccgcgatcgacggggagtaccgcctgaagggcgagtcccggaagaccttcgtggagctcatgcgccggggcgacctgccggtctggctggcccacaaggtggccagcgaggggatcaagtacaccgaccgcaagtggtgcttcgacggcgagcggaacaaccagatcctcgaggagaacatggacgtggagatctggacgcgcgagggggagaagaagaagctgcggccccgctggctggacgcccggacctactccgaccccctcgccctgaaggagttcaaggacttcgcggccggccgcaagagcatcgccctggacctcgtcaccgagatcggccgcgtgccctcccacctggcccaccggacccgcaacgccctggacaacctcgtcatgctgcacacgagcgagcacgggggccgggcgtaccgccacgccgtggaggagctgccggagaccatggagaccctcctgctgctcgggctgatgatcctgctcaccggcggggccatgctgttcctgatcagcggcaagggcatcgggaagacgtccatcggcctcatctgcgtggtcgccagctccgggatgctgtggatggccgacgtgcccctgcagtggatcgcgagcgccatcgtgctcgagttcttcatgatggtcctgctgatccccgagccggagaagcagcggacgccccaggacaaccagctcgcctacgtggtgatcggcatcctgaccctggccgccatcgtcgcggccaacgagatggggctcctggagaccacgaagcgcgacctgggcatgtccaaggagcccggcgtggtgagccccacctcctacctcgacgtcgacctgcacccggccagcgcctggaccctgtacgcggtggccaccacggtgatcacccccatgctccggcacaccatcgagaactccaccgccaacgtcagcctggccgccatcgcgaaccaggccgtggtgctgatggggctcgacaagggctggcccatctccaagatggacctgggggtccccctgctcgccctgggctgctacagccaggtgaacccgctgacgctcaccgccgccgtgctgctgctcgtcacccactacgcgatcatcgggcccggcctgcaggccaaggccacccgcgaggcccagaagcggacggccgcgggcatcatgaagaaccccaccgtggacgggatcatgaccatcgacctggaccccgtgatctacgactccaagttcgagaagcagctcggccaggtcatgctgctggtgctctgcgccgtgcagctgctgctcatgcgcaccagctgggccttctgcgaggccctgacgctggcgaccgggccgatcaccaccctctgggagggctcccccggcaagttctggaacacgaccatcgccgtcagcatggccaacatcttccgggggtcctacctggccggcgccgggctggcgttcagcatcatgaagtccgtgggcaccgggaagcgcggcaccggcagccagggggagacgctcggcgagaagtggaagaagaagctgaaccagctgagccggaaggagttcgacctctacaagaagtccgggatcaccgaggtggaccgcatcgaggccaaggagggcctgaagcgcggggagatcacccaccacgccgtcagccgcggctccgccaagctgcagtggttcgtggagcggaacatggtgatccccgagggccgcgtcatcgacctcgggtgcggccgcgggggctggagctactactgcgccgggctgaagaaggtgaccgaggtgcgcggctacaccaagggcgggcccggccacgaggagccggtccccatgtccacgtacgggtggaacatcgtgaagctgatgagcggcaaggacgtgttctacctgccgcccgagaagtgcgacaccctgctgtgcgacatcggggagtccagcccgtcccccaccgtcgaggagagccggaccatccgcgtgctgaagatggtggagccctggctcaagaacaaccagttctgcatcaaggtcctgaacccctacatgccgacggtgatcgagcacctggagcgcctccagcggaagcacggcggcatgctggtgcgcaaccccctgtcccggaacagcacccacgagatgtactggatctccaacgggaccggcaacatcgtcagctccgtgaacatggtgagccgcctcctgctgaaccggttcaccatgacgcaccgccggcccaccatcgagaaggacgtcgacctcggggcgggcacccgccacgtgaacgccgagcccgagaccccgaacatgaacgtgatcggcgagcggatccgccggatcaaggaggagcactccagcacgtggcactacgacgacgagaacccctacaagacctgggcctaccacgggtcctacgaggtcaaggccaccggcagcgccagctccatgatcaacggggtggtcaagctgctgaccaagccctgggacgtggtgccgatggtcacgcagatggcgatgaccgacaccacccccttcggccagcagcgcgtgttcaaggagaaggtggacacgcggacgccccggcccatgccggggacccggaaggtcatggagatcaccgccgagtggctctggcgcacgctgggccggaacaagcgcccccggctgtgcacccgcgaggagttcatcaagaaggtgcgcaccaacgccgccatgggcgcggtgttcaccgaggagaaccagtgggacagcgcccgggccgccgtcgaggacgaggagttctggaagctcgtggaccgcgagcgggagctgcacaagctggggaagtgcggctcctgcgtgtacaacatgatggggaagcgcgagaagaagctcggcgagttcgggaaggccaagggcagccgggcgatctggtacatgtggctgggcgcccgctacctggagttcgaggccctcgggttcctgaacgaggaccactggttctcccgggagaacagccactccggcgtcgagggggagggcctgcacaagctcgggtacatcctgcgcgacatcagcaagatccccggcggcgccatgtacgccgacgacacggcggggtgggacacccggatcaccgaggacgacctgcacaacgaggagaagatcacccagcagatggaccccgagcaccgccagctcgccaacgccatcttcaagctgacgtaccagaacaaggtggtgaaggtccagcggccgacccccaagggcaccgtgatggacatcatctcccgcaaggaccagcgggggagcggccaggtgggcacctacgggctgaacacgttcaccaacatggaggcccagctcatccgccagatggagggcgagggggtcctgtccaaggccgacctggagaacccccacctcctggagaagaaggtgacccagtggctggagaccaagggcgtggagcggctcaagcgcatggcgatcagcggggacgactgcgtcgtgaagcccatcgacgaccggttcgccaacgccctgctggccctcaacgacatgggcaaggtgcgcaaggacatcccgcagtggcagccctccaagggctggcacgactggcagcaggtccccttctgcagccaccacttccacgagctgatcatgaaggacgggcggaagctggtggtgccctgccgcccgcaggacgagctcatcggccgggcccgcatctcccagggggcgggctggagcctgcgcgagaccgcctgcctggggaaggcctacgcccagatgtgggcgctcatgtacttccaccggcgcgacctgcggctggcctccaacgccatctgcagcgccgtccccgtgcactgggtgcccacgtcccgcaccacctggagcatccacgcccaccaccagtggatgaccacggaggacatgctcaccgtctggaaccgggtgtggatcgaggacaacccctggatggaggacaagaccccggtgaccacgtgggaggacgtcccctacctgggcaagcgcgaggaccagtggtgcggcagcctgatcgggctcacctcccgggcgacctgggcccagaacatcctgaccgccatccagcaggtccgcagcctgatcggcaacgaggagttcctcgactacatgccctccatgaagcggttccgcaaggaggaggagagcgagggggccatctggtga

SEQ ID NO: 10377 - RNA, 9873 nt, synthetic construct
  misc_feature 1..9873: note = derived and/or modified CDS sequence (opt1) from DENV-3__KF824902__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtggagaaggtcgagacgtgggccctccgccacccggggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctcccggaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccaccaccgagacccccacgtggaaccgcaaggagctgctggtgaccttcaagaacgcccacgcgaagaagcaggaggtcgtggtgctcgggagccaggagggcgccatgcacaccgccctgaccggggccacggagatccagaactccggcgggaccagcatcttcgccggccacctgaagtgccggctcaagatggacaagctggagctgaagggcatgtcctacgcgatgtgcctcaacaccttcgtcctgaagaaggaggtgagcgagacccagcacgggacgatcctgatcaaggtggagtacaagggcgaggacgccccctgcaagatcccgttcagcaccgaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccacggcccggggcgcccgccggatggcgatcctgggcgacaccgcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacgtccatgagcttctcctgcatcgtcatcggcatcatcaccctgtacctcgggaccgtggtgcaggccgacatgggctgcgtcatcaactggaagggcaaggagctgaagtgcgggagcggcatcttcgtgaccaacgaggtgcacacgtggaccgagcagtacaagttccaggcggactcccccaagcgcctggccaccgccatcgccggggcctgggagaacggcgtctgcgggatccgcagcaccacgcggatggagaacctcctgtggaagcagatcgcgaacgagctgaactacatcctctgggagaacaacatcaagctgaccgtggtggtcggcgacatcatcggcgtgctggagcaggggaagcgcgccctcaccccccagcccatggagctgaagtactcctggaagacctggggcaaggccaagatcgtgacggccgagatccagaacagctccttcatcatcgacgggccgaacacccccgagtgccccagcgcgtcccgggcctggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgcggacatggggtactggatcgagagccagaagaacggctcctggaagctggagaaggccagcttcatcgaggtgaagacctgcacctggcccaagacccacacgctctggtccaacggggtcctggagagcgacatgatcatcccgaagtccctggccggccccatcagccagcacaaccaccggcccgggtaccacacccagaccgccggcccgtggcacctcggcaagctggagctggacttcaactactgcgaggggaccacggtggtgatcaccgagaactgcggcacccgcgggccctccctccggaccacgaccgtcagcggcaagctgatccacgagtggtgctgccgctcctgcaccctgccccccctccggtacatgggggaggacggctgctggtacggcatggagatccgcccgatcaacgagaaggaggagaacatggtgaagagcctggtgtccgccgggagcggcaaggtcgacaacttcaccatgggggtgctgtgcctcgcgatcctgttcgaggaggtgatgcggggcaagttcgggaagaagcacatgatcgccggcgtcctgttcacgttcatgctcctgctgtccggccagatcacctggcgcgacatggcccacaccctcatcatgatcgggagcaacgcctccgaccggatgggcatgggggtgacctacctggccctgatcgcgacgttcaagatccagcccttcctcgccctgggcttcttcctgcgcaagctcaccagccgggagaacctgctgctcggcgtggggctggccatggccaccaccctgcagctccccgaggacatcgagcagatggcgaacggcatcgccctggggctgatggccctcaagctgatcacgcagttcgagacctaccagctgtggaccgccctcgtctccctgacctgcagcaacacgatcttcaccctgaccgtggcctggcgcaccgcgacgctcatcctggccggcgtgagcctgctccccgtctgccagtccagctccatgcggaagaccgactggctgccggtggccgtcgccgccatgggggtgccccccctgcccctcttcatcttcagcctgaaggacaccctgaagcgccgctcctggccgctcaacgagggcgtgatggcggtcggcctggtgagcatcctggcctccagcctcctgcggaacgacgtgcccatggccgggcccctggtcgccggcgggctcctgatcgcctgctacgtgatcaccggcacgtccgcggacctgaccgtggagaaggccgccgacgtcacctgggaggaggaggccgagcagaccggggtgagccacaacctcatgatcacggtggacgacgacggcaccatgcgcatcaaggacgacgagaccgagaacatcctgaccgtcctgctcaagaccgccctgctgatcgtgtccggcatcttcccctacagcatcccggcgacgctcctggtgtggcacacctggcagaagcagacccagcggtccggggtcctgtgggacgtgcccagcccccccgagacccagaaggccgagctcgaggagggcgtgtaccgcatcaagcagcaggggatcttcggcaagacgcaggtcggggtgggcgtgcagaaggagggcgtcttccacaccatgtggcacgtgacccggggggccgtgctgacccacaacggcaagcgcctggagccgaactgggcctccgtcaagaaggacctcatcagctacgggggcgggtggcggctgtccgcgcagtggcagaagggcgaggaggtgcaggtgatcgccgtcgagcccggccgcaaccccaagaacttccagacgatgcccgggatcttccagaccaccaccggcgagatcggggccatcgccctggacttcaagccgggcacgagcggctcccccatcatcaaccgggaggggaaggtggtgggcctgtacgggaacggcgtcgtgaccaagaacgggggctacgtgagcggcatcgcccaggcgaacgccgagcccgaggggccgacccccgagctcgaggaggagatgttcaagaagcgcaacctgaccatcatggacctgcaccccggcagcgggaagacgcggaagtacctccccgccatcgtccgcgaggccatcaagcggcgcctgcggaccctgatcctcgccccgacccgcgtggtggcggccgagatggaggaggccctgaagggcctgcccatccggtaccagaccacggccaccaagtccgagcacaccgggcgcgagatcgtcgtgctcatgtgccacgccaccttcacgatgcggctgctgagccccgtgcgcgtccccaactacaacctcatcatcatggacgaggcgcacttcaccgacccggcctccatcgccgcccggggctacatcagcacccgcgtgggcatgggggaggcggccgccatcttcatgaccgccacgccccccggcaccgccgaggcgttcccccagtccaacgccccgatccaggacgaggagcgcgacatccccgagcggagctggaactccgggaacgagtggatcaccgacttcgtgggcaagaccgtctggttcgtgcccagcatcaaggccgggaacgacatcgccaactgcctgcgcaagaacggcaagaaggtgatccagctgtcccggaagacgttcgacaccgagtaccagaagaccaagctcaacgactgggacttcgtcgtgaccacggacatcagcgagatgggcgccaacttcaaggcggaccgcgtgatcgacccccggcgctgcctgaagccggtcatcctgaccgacgggcccgagcgggtgatcctcgccggccccatgcccgtgaccgccgcctccgccgcgcagcgccgggggcgcgtcggccggaacccgcagaaggagaacgaccagtacatcttcatggggcagcccctgaacaacgacgaggaccacgcccactggaccgaggccaagatgctgctcgacaacatcaacacgcccgagggcatcatccccgccctgttcgagccggagcgcgagaagagcgcggccatcgacggcgagtaccggctgaagggggagtcccgcaagaccttcgtggagctcatgcggcgcggcgacctgcccgtctggctggcccacaaggtggccagcgaggggatcaagtacaccgaccggaagtggtgcttcgacggcgagcgcaacaaccagatcctcgaggagaacatggacgtggagatctggaccaaggagggcgagcggaagaagctgcgcccccgctggctggacgcccggacctactccgaccccctcgcgctgaaggagttcaaggacttcgccgccgggcgcaagagcatcgccctggacctcgtcacggagatcggccgggtgccgtcccacctggcccaccgcacccggaacgcgctggacaacctcgtgatgctgcacaccagcgagcacgggggccgcgcctaccggcacgccgtcgaggagctgcccgagaccatggagacgctcctgctgctcgggctgatgatcctgctcaccggcggcgccatgctgttcctgatctccgggaagggcatcgggaagaccagcatcggcctcatctgcgtgatcgtgagctccgggatgctgtggatggccgacgtccccctgcagtggatcgcgagcgccatcgtgctcgagttcttcatgatggtgctgctgatcccggagcccgagaagcagcgcaccccccaggacaaccagctcgcctacgtcgtgatcggcatcctgacgctggccgccatcgtggcggccaacgagatgggcctcctggagaccaccaagcgggacctggggatgtccaaggagcccggcgtcgtgagcccgacctcctacctcgacgtggacctgcaccccgccagcgcctggacgctgtacgcggtcgccaccaccgtgatcacccccatgctccgccacacgatcgagaactccaccgccaacgtgagcctggccgccatcgcgaaccaggccgtcgtgctgatggggctcgacaagggctggcccatctccaagatggacctgggggtgccgctgctcgccctgggctgctacagccaggtcaaccccctgaccctcaccgccgccgtgctgctgctcgtgacgcactacgcgatcatcggccccgggctgcaggccaaggccacccgggaggcccagaagcgcaccgccgcgggcatcatgaagaaccccaccgtcgacgggatcatgacgatcgacctggacccggtgatctacgactccaagttcgagaagcagctcggccaggtgatgctgctggtcctctgcgccgtgcagctgctgctcatgcggaccagctgggccctgtgcgaggccctgaccctcgcgaccggccccatcacgaccctgtgggaggggtcccccggcaagttctggaacaccaccatcgccgtgagcatggccaacatcttccgcgggtcctacctggccggcgccgggctcgcgttcagcatcatgaagtccgtcggcacgggcaagcgggggaccggcagccagggggagaccctgggcgagaagtggaagaagaagctgaaccagctctcccgccgggagttcgagctgtacaagaagagcgggatcaccgaggtggaccgcacggaggccaaggagggcctgaagcggggcgagaccacccaccacgccgtgagccgcgggtccgccaagctccagtggttcgtcgagcggaacatggtgatccccgagggccgcgtgatcgacctggggtgcggccgcgggggctggagctactactgcgccggcctgaagaaggtcaccgaggtgcgggggtacaccaagggcgggccgggccacgaggagcccgtgcccatgtccacgtacgggtggaacaccgtcaagctcatgagcggcaaggacgtgttctacctgcccccggagaagtgcgacaccctgctgtgcgacatcggcgagtccagcccctcccccaccgtggaggagagccgcacgatccgggtcctcaagatggtggagccctggctgaagaacaaccagttctgcatcaaggtgctgaacccgtacatgcccaccgtcatcgagcacctcgagcgcctgcagcggaagcacgggggcatgctggtgcgcaaccccctctcccggaacagcacccacgagatgtactggatctccaacgggaccggcaacatcgtgagctccgtcaacatggtgagccgcctgctgctcaaccggttcacgatgacccaccgccggcccaccatcgagaaggacgtcgacctgggcgcggggacccgccacgtgaacgccgagccggagacgcccaacatggacgtgatcggcgagcggatcaagcgcatcaaggaggagcactccagcacctggcactacgacgacgagaacccctacaagacctgggcctaccacgggtcctacgaggtcaaggccaccggcagcgcctccagcatgatcaacggggtggtgaagctgctcacgaagccgtgggacgtcgtgcccatggtgacccagatggcgatgaccgacaccacgcccttcggccagcagcgggtcttcaaggagaaggtggacacccgcaccccccggccgatgcccggcacccgcaaggtgatggagatcacggccgagtggctgtggcggaccctggggcgcaacaagcgcccccggctctgcacccgcgaggagttcaccaagaaggtccggacgaacgccgccatgggcgcggtgttcaccgaggagaaccagtgggagagcgcccgcgccgccgtggaggacgaggagttctggaagctggtcgggcgggagcgcgagctgcacaagctcggcaagtgcgggtcctgcgtgtacaacatgatgggcaagcgggagaagaagctgggcgagttcgggaaggccaagggcagccgcgcgatctggtacatgtggctgggggcccggtacctcgagttcgaggccctgggcttcctgaacgaggaccactggttctcccgcgagaacagctactccggggtggagggcgagggcctccacaagctggggtacatcctgcgggacatcagcaagatccccggcggggccatgtacgccgacgacaccgcgggctgggacacccgcatcacggaggacgacctccacaacgaggagaagatcacccagcagatggacccggagcaccggcagctggccaacgccatcttcaagctgacctaccagaacaaggtcgtgaaggtgcagcgccccacccccaagggcacggtcatggacatcatctcccggaaggaccagcgcgggagcggccaggtggggacctacggcctcaacaccttcaccaacatggaggcccagctgatccggcagatggagggggagggcgtgctgtccaaggccgacctcgagaacccccacctgctggagaagaagatcacccagtggctcgagacgaagggcgtcgagcgcctgaagcggatggcgatcagcggggacgactgcgtggtgaagccgatcgacgaccgcttcgccaacgccctgctcgccctgaacgacatgggcaaggtccggaaggacatcccccagtggcagccctccaaggggtggcacgactggcagcaggtgcccttctgcagccaccacttccacgagctgatcatgaaggacggccgcaagctcgtggtcccgtgccgcccccaggacgagctgatcgggcgggcccgcatctcccagggcgcgggctggagcctgaaggagaccgcctgcctcgggaaggcctacgcccagatgtggtccctgatgtacttccaccggcgcgacctgcggctcgcgagcaacgccatctgctccgccgtgcccgtgcactgggtccccaccagccgcaccacgtggtccatccacgcccaccaccagtggatgaccaccgaggacatgctgaccgtgtggaaccgggtgtggatcgaggacaacccgtggatggaggacaagacgcccgtcaccacctgggaggacgtgccctacctgggcaagcgcgaggaccagtggtgcgggagcctcatcggcctgaccagccgggccacgtgggcgcagaacatcctgaccgccatccagcaggtgcgctccctcatcggggacgaggagttcctggactacatgcccagcatgaagcggttccgcaaggaggaggagtccgagggcgccatctggtga

SEQ ID NO: 10378 - RNA, 9873 nt, synthetic construct
  misc_feature 1..9873: note = derived and/or modified CDS sequence (opt1) from DENV-3__KF824903__SS-prME
  source 1..9873: mol_type = other RNA
accagcctgtgcctcatgatgatgctgcccgccaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacgtgcaaccaggccggcgagcaccggcgcgacaagcggtccgtggccctggcgccccacgtgggcatggggctggacacccgcacccagacctggatgagcgccgagggcgcctggcgccaggtggagaaggtcgagacgtgggccctccgccaccccgggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctcccggaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgaccatcacggtgcacaccggggaccagcaccaggtcggcaacgacacccagggggtgaccgccgagatcacgccccaggcgtccaccgtcgaggccatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacgtccggcgccaccaccgagacccccacgtggaaccgcaaggagctgctggtgaccttcaagaacgcccacgcgaagaagcaggaggtcgtggtgctcgggagccaggagggcgccatgcacaccgccctgaccggggccacggagatccagaactccggcgggaccagcatcttcgccggccacctgaagtgccggctcaagatggacaagctggagctgaagggcatgtcctacgcgatgtgcctcaacaccttcgtcctgaagaaggaggtgagcgagacccagcacgggacgatcctgatcaaggtggagtacaagggcgaggacgccccctgcaagatcccgttcagcaccgaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctcaagatcaactggtacaagaagggcagctccatcgggaagatgttcgaggccacggcccggggcgcccgccggatggcgatcctgggcgacaccgcctgggacttcgggagcgtgggcggggtgctgaactccctcggcaagatggtccaccagatcttcgggagcgcctacaccgccctgttcggcggcgtgtcctggatcatgaagatcgggatcggcgtgctgctcacctggatcgggctgaacagcaagaacacgtccatgagcttctcctgcatcgtcatcggcatcatcaccctgtacctcgggaccgtggtgcaggccgacatgggctgcgtcatcaactggaagggcaaggagctgaagtgcgggagcggcatcttcgtgaccaacgaggtgcacacgtggaccgagcagtacaagttccaggcggactcccccaagcgcctggccaccgccatcgccggggcctgggagaacggcgtctgcgggatccgcagcaccacgcggatggagaacctcctgtggaagcagatcgcgaacgagctgaactacatcctctgggagaacaacatcaagctgaccgtggtggtcggcgacatcatcggcgtgctggagcaggggaagcgcgccctcacgccccagcccatggagctgaagtactcctggaagacctggggcaaggccaagatcgtgacggccgagatccagaacagctccttcatcatcgacgggccgaacacccccgagtgccccagcgcgtcccgggcctggaacgtctgggaggtggaggactacggcttcggcgtgttcaccaccaacatctggctgaagctccgcgaggtctacacgcagacctgcgaccaccggctgatgagcgccgccatcaaggacgagcgcgccgtgcacgcggacatggggtactggatcgagagccagaagaacggctcctggaagctggagaaggccagcttcatcgaggtgaagacctgcacctggcccaagtcccacaccctctggagcaacggggtcctggagtccgacatgatcatccccaagagcctggccggccccatctcccagcacaaccaccggcccgggtaccacacgcagaccgccggcccgtggcacctcggcaagctggagctggacttcaactactgcgaggggaccaccgtggtgatcacggagaactgcggcacccgcgggcccagcctccggaccaccacggtctccggcaagctgatccacgagtggtgctgccgcagctgcaccctgccgcccctccggtacatgggggaggacggctgctggtacggcatggagatccgcccgatcaacgagaaggaggagaacatggtgaagtccctggtgagcgccgggtccggcaaggtcgacaacttcaccatgggggtgctgtgcctcgcgatcctgttcgaggaggtgatgcggggcaagttcgggaagaagcacatgatcgccggcgtcctgttcaccttcatgctcctgctgagcggccagatcacgtggcgcgacatggcccacaccctcatcatgatcgggtccaacgccagcgaccggatgggcatgggggtgacctacctggccctgatcgcgaccttcaagatccagcccttcctcgccctgggcttcttcctgcgcaagctcacgtcccgggagaacctgctgctcggcgtggggctggccatggccaccaccctgcagctccccgaggacatcgagcagatggcgaacggcatcgccctggggctgatggccctcaagctgatcacccagttcgagacgtaccagctgtggaccgccctcgtcagcctgacctgcagcaacaccatcttcacgctgaccgtggcctggcgcaccgcgaccctcatcctggccggcgtgtccctgctccccgtctgccagagctccagcatgcggaagacggactggctgccggtggccgtcgccgccatgggggtgccgcccctccccctcttcatcttctccctgaaggacaccctgaagcgccgcagctggccgctcaacgagggcgtgatggcggtcggcctggtgtccatcctggccagctccctcctgcggaacgacgtgcccatggccgggcccctggtcgccggcgggctcctgatcgcctgctacgtgatcaccggcaccagcgcggacctgacggtggagaaggccgccgacgtcacctgggaggaggaggccgagcagaccggggtgtcccacaacctcatgatcaccgtggacgacgacggcacgatgcgcatcaaggacgacgagaccgagaacatcctgaccgtcctgctcaagaccgccctgctgatcgtgagcggcatcttcccctactccatcccggcgaccctcctggtgtggcacacgtggcagaagcagacccagcggagcggggtcctgtgggacgtgcccagcccgcccgagacccagaaggccgagctcgaggagggcgtgtaccgcatcaagcagcaggggatcttcggcaagacccaggtcggggtgggcgtgcagaaggagggcgtcttccacacgatgtggcacgtgacccgcggggccgtgctgacccacaacggcaagcgcctggagccgaactgggccagcgtcaagaaggacctcatctcctacgggggcgggtggcggctgagcgcgcagtggcagaagggcgaggaggtccaggtgatcgccgtcgagcccggccgcaaccccaagaacttccagaccatgcccgggatcttccagacgaccaccggcgagatcggggccatcgccctggacttcaagccgggcacctccggcagccccatcatcaaccgggaggggaaggtggtgggcctgtacgggaacggcgtcgtgacgaagaacgggggctacgtgagcggcatcgcccaggcgaacgccgagcccgaggggccgacccccgagctcgaggaggagatgttcaagaagcgcaacctgaccatcatggacctgcaccccggctccgggaagacccggaagtacctccccgccatcgtccgcgaggccatcaagcggcgcctgcggacgctgatcctcgccccgacccgcgtggtggcggccgagatggaggaggccctgaagggcctgcccatccggtaccagaccaccgccaccaagtccgagcacaccgggcgcgagatcgtcgagtgcatgtgccacgccaccttcaccatgcggctcctgtcccccgtgcgcgtgcccaactacaacctgatcatcatggacgaggcgcacttcacggacccggccagcatcgccgcccggggctacatctccacccgcgtcggcatgggggaggcggccgccatcttcatgaccgccacgccgcccggcacggccgaggcgttcccccagagcaacgccccgatccaggacgaggagcgcgacatccccgagcggtcctggaacagcgggaacgagtggatcaccgacttcgtgggcaagaccgtgtggttcgtcccctccatcaaggccgggaacgacatcgccaactgcctccgcaagaacggcaagaaggtgatccagctgagccggaagaccttcgacacggagtaccagaagaccaagctgaacgactgggacttcgtggtcaccaccgacatctccgagatgggcgccaacttcaaggcggaccgcgtgatcgacccccggcgctgcctcaagccggtgatcctgacggacgggcccgagcgggtcatcctggccggccccatgcccgtgaccgccgccagcgccgcgcagcgccgggggcgcgtgggccggaacccgcagaaggagaacgaccagtacatcttcaccgggcagcccctcaacaacgacgaggaccacgcccactggaccgaggccaagatgctgctggacaacatcaacacgcccgagggcatcatccccgccctcttcgagccggagcgcgagaagtccgcggccatcgacggcgagtaccggctgaagggggagagccgcaagaccttcgtcgagctgatgcggcgcggcgacctccccgtgtggctggcccacaaggtcgcctccgaggggatcaagtacaccgaccggaagtggtgcttcgacggcgagcgcaacaaccagatcctggaggagaacatggacgtggagatctggaccaaggagggcgagcggaagaagctccgcccccgctggctggacgcccggacctacagcgaccccctggcgctcaaggagttcaaggacttcgccgccgggcgcaagtccatcgccctggacctggtgacggagatcggccgggtcccgagccacctcgcccaccgcacccggaacgcgctggacaacctggtgatgctccacacctccgagcacgggggccgcgcctaccggcacgccgtggaggagctgcccgagaccatggagacgctgctcctgctggggctcatgatcctgctgaccggcggcgccatgctgttcctgatcagcgggaagggcatcgggaagaccagcatcggcctgatctgcgtcatcgtgtccagcgggatgctctggatggccgacgtgcccctgcagtggatcgcgtccgccatcgtcctggagttcttcatgatggtgctcctgatcccggagcccgagaagcagcgcacgccccaggacaaccagctggcctacgtggtcatcggcatcctcacgctggccgccatcgtggcggccaacgagatgggcctgctcgagaccaccaagcgggacctggggatgagcaaggagcccggcgtggtctccccgaccagctacctggacgtggacctccaccccgcctccgcctggacgctgtacgcggtggccaccaccgtcatcacccccatgctgcgccacacgatcgagaacagcaccgccaacgtgtccctcgccgccatcgcgaaccaggccgtggtcctgatggggctggacaagggctggcccatcagcaagatggacctcggggtgccgctgctggccctcggctgctactcccaggtgaaccccctgaccctgaccgccgccgtcctcctgctggtgacgcactacgcgatcatcggccccgggctccaggccaaggccacccgggaggcccagaagcgcaccgccgcgggcatcatgaagaaccccaccgtggacgggatcatgacgatcgacctggacccggtcatctacgacagcaagttcgagaagcagctgggccaggtgatgctcctggtgctgtgcgccgtccagctcctgctgatgcggacctcctgggccctctgcgaggccctgaccctggcgaccggccccatcacgaccctctgggaggggagccccggcaagttctggaacaccaccatcgccgtgtccatggccaacatcttccgcgggagctacctggccggcgccgggctggcgttctccatcatgaagtccgtgggcacgggcaagcgggggaccggctcccagggggagaccctcggcgagaagtggaagaagaagctgaaccagctgagccgccgggagttcgagctctacaagaagtccgggatcaccgaggtcgaccgcacggaggccaaggagggcctgaagcggggcgagaccacccaccacgccgtgtcccgcgggagcgccaagctgcagtggttcgtggagcggaacatggtcatccccgagggccgcgtgatcgacctcgggtgcggccgcgggggctggtcctactactgcgccggcctgaagaaggtgaccgaggtccgggggtacaccaagggcgggccgggccacgaggagcccgtgcccatgagcacgtacgggtggaacaccgtgaagctgatgtccggcaaggacgtcttctacctcccgcccgagaagtgcgacaccctgctgtgcgacatcggcgagagctcccccagccccaccgtggaggagtcccgcacgatccgggtgctgaagatggtcgagccctggctcaagaacaaccagttctgcatcaaggtgctgaacccctacatgcccaccgtgatcgagcacctggagcgcctccagcggaagcacgggggcatgctggtccgcaaccccctgagccggaactccacccacgagatgtactggatcagcaacgggaccggcaacatcgtgtccagcgtgaacatggtctcccgcctcctgctgaaccggttcacgatgacccaccgccggcccaccatcgagaaggacgtggacctcggcgcggggacccgccacgtcaacgccgagccggagacgcccaacatggacgtgatcggcgagcggatcaagcgcatcaaggaggagcacagctccacctggcactacgacgacgagaacccctacaagacctgggcctaccacgggagctacgaggtgaaggccaccggctccgccagcagcatgatcaacggggtcgtgaagctgctgacgaagccgtgggacgtggtccccatggtgacccagatggcgatgaccgacaccacgcccttcggccagcagcgggtgttcaaggagaaggtcgacacccgcacgccccggccgatgcccggcacccgcaaggtgatggagatcaccgccgagtggctctggcggaccctggggcgcaacaagcgcccccggctgtgcacccgcgaggagttcaccaagaaggtgcggacgaacgccgccatgggcgcggtcttcaccgaggagaaccagtgggagtccgcccgcgccgccgtggaggacgaggagttctggaagctcgtggggcgggagcgcgagctgcacaagctgggcaagtgcgggagctgcgtctacaacatgatgggcaagcgggagaagaagctcggcgagttcgggaaggccaagggctcccgcgcgatctggtacatgtggctgggggcccggtacctggagttcgaggccctcggcttcctgaacgaggaccactggttcagccgcgagaactcctacagcggggtggagggcgagggcctgcacaagctcgggtacatcctgcgggacatctccaagatccccggcggggccatgtacgccgacgacaccgcgggctgggacacccgcatcacggaggacgacctgcacaacgaggagaagatcacccagcagatggacccggagcaccggcagctcgccaacgccatcttcaagctgacctaccagaacaaggtggtcaaggtgcagcgccccacccccaagggcacggtgatggacatcatcagccggaaggaccagcgcgggtccggccaggtcgggacctacggcctgaacaccttcaccaacatggaggcccagctcatccggcagatggagggggagggcgtgctgagcaaggccgacctggagaacccccacctcctggagaagaagatcacccagtggctggagacgaagggcgtggagcgcctcaagcggatggcgatctccggggacgactgcgtcgtgaagccgatcgacgaccgcttcgccaacgccctgctggccctcaacgacatgggcaaggtgcggaaggacatcccccagtggcagcccagcaaggggtggcacgactggcagcaggtccccttctgctcccaccacttccacgagctgatcatgaaggacggccgcaagctggtggtgccgtgccgcccccaggacgagctcatcgggcgggcccgcatcagccagggcgcgggctggtccctgaaggagaccgcctgcctggggaaggcctacgcccagatgtggagcctcatgtacttccaccggcgcgacctgcggctggcgtccaacgccatctgcagcgccgtccccgtgcactgggtgcccacctcccgcaccacgtggagcatccacgcccaccaccagtggatgaccaccgaggacatgctcaccgtctggaaccgggtgtggatcgaggacaacccgtggatggaggacaagacgcccgtgaccacctgggaggacgtcccctacctgggcaagcgcgaggaccagtggtgcgggagcctgatcggcctcacctcccgggccacgtgggcgcagaacatcctgaccgccatccagcaggtccgcagcctgatcggggacgaggagttcctcgactacatgccctccatgaagcggttccgcaaggaggaggagagcgagggcgccatctggtga

SEQ ID NO: 10379 - RNA, 9873 nt, synthetic construct
  misc_feature 1..9873: note = derived and/or modified CDS sequence (opt1) from DENV-3__JF504679__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccggatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcggacatggggtgcgtcatcaactggaagggcaaggagctgaagtgcggcagcgggatcttcgtgacgaacgaggtgcacacctggaccgagcagtacaagttccaggccgactcccccaagcgcctcgccaccgtcatcgccggcgcctgggagaacggggtgtgcggcatccgcagcacgacccggatggagaacctgctgtggaagcagatcgcgaacgagctcaactacatcctgtgggagaacaacatcaagctgaccgtggtcgtgggggacaccatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagatgtgcgaccaccggctgatgagcgccgccgtgaaggacgagcgcgccgtccacgccgacatgggctactggatcgagagccagaagaacgggtcctggaagctcgagaaggcgagcctgatcgaggtgaagacgtgcacctggccgaagtcccacaccctgtggagcaacggcgtgctcgagtccgacatgatcatccccaagagcctggccgggcccgtctcccagcacaactaccggccgggctaccacacccagacggccgggccctggcacctgggcaagctcgagctggacttcaactactgcgagggcaccaccgtggtgatcaccgagaactgcgggacgcgcggccccagcctgcggaccaccaccgtctccgggaagctcatccacgagtggtgctgccgcagctgcacgctgcccccgctgcggtacatgggcgaggacgggtgctggtacggcatggagatccgccccatctccgagcgggaggagaacatggtcaagagcctcgtgtccgccggcagcgggaaggtcgacaacttcaccatgggcgtgctgtgcctggccatcctcttcgaggaggtgatgcgcgggaagttcggcaagaagcacatgatcgcgggggtcttcttcaccttcatgctgctgctctccggccagatcacctggcgggacatggcccacacgctgatcatgatcggcagcaacgcctccgaccgcatggggatgggcgtgacctacctggccctcatcgccaccttcaagatccagcccttcctggcgctggggttcttcctccggaagctgaccagccgcgagaacctgctcctgggcgtgggcctggccatggccacgaccatccagctccccgaggacatcgagcagatggccaacgggatcgcgctgggcctgatggccctcaagctgatcacccagttcgagacctaccagctgtggacggccctcatcagcctgacctgctccaacaccatcttcaccctgacggtcgcctggcggaccgccaccctcatcctggcgggggtgagcctgctcccggtctgccagtccagctccatgcgcaagaccgactggctgcccatgacggtggccgccatgggcgtgccgcccctgcccctcttcatcttcagcctgaaggacaccctgaagcgccggtcctggcccctcaacgagggggtcatggccgtgggcctggtgagcatcctggcctccagcctcctgcgcaacgacgtccccatggcgggccccctggtggccgggggcctcctgatcgcctgctacgtgatcaccgggacctccgccgacctgacggtcgagaaggccgcggacgtgacctgggaggaggaggccgagcagaccggcgtgagccacaacctcatgatcaccgtcgacgacgacgggaccatgcggatcaaggacgacgagacggagaacatcctgaccgtgctgctcaagaccgccctgctgatcgtgtccggcatcttcccgtacagcatccccgccaccctcctggtctggcacacgtggcagaagcagacccagcgctccggcgtgctgtgggacgtgcccagcccgcccgagacccagaaggccgagctcgaggagggggtctaccggatcaagcagcagggcatcctggggaagacccaggtgggcgtgggggtccagaaggagggcgtgttccacacgatgtggcacgtgacccgcggcgcggtcctgacccacaacgggaagcggctcgagcccaactgggcctccgtgaagaaggacctgatcagctacggcgggggctggcgcctgtccgcccagtggcagaagggggaggaggtgcaggtcatcgccgtggagcccggcaagaaccccaagaacttccagaccatgcccggcacgttccagaccaccaccggggagatcggcgcgatcgccctcgacttcaagcccgggacgagcggcagccccatcatcaaccgggagggcaaggtggtcgggctgtacggcaacggggtggtgaccaagaacggcgggtacgtctccggcatcgcccagaccaacgccgagccggacggccccacccccgagctggaggaggagatgttcaagaagcgcaacctgacgatcatggacctccaccccgggagcggcaagacccggaagtacctgccggccatcgtgcgcgaggcgatcaagcggcgcctgcggaccctcatcctggcccccacccgcgtggtcgccgccgagatggaggaggccctgaaggggctccccatccggtaccagacgaccgcgaccaagtccgagcacaccggccgcgagatcgtggacctgatgtgccacgccacgttcaccatgcggctgctcagccccgtgcgcgtcccgaactacaacctgatcatcatggacgaggcccacttcaccgaccccgcctccatcgccgcgcgggggtacatcagcacccgcgtgggcatgggcgaggccgccgccatcttcatgacggcgacgccgcccgggaccgccgacgccttcccgcagtccaacgcccccatccaggacgaggagcgcgacatccccgagcggagctggaactccggcaacgagtggatcaccgacttcgccgggaagacggtgtggttcgtccccagcatcaaggcgggcaacgacatcgccaactgcctgcgcaagaacgggaagaaggtgatccagctctcccggaagaccttcgacaccgagtaccagaagaccaagctgaacgactgggacttcgtggtcacgaccgacatcagcgagatgggcgccaacttcaaggccgaccgcgtgatcgacccgcggcgctgcctgaagcccgtgatcctcaccgacggccccgagcgggtcatcctggccgggcccatgccggtgaccgtggcgtccgccgcccagcgccggggccgcgtcgggcggaacccccagaaggagaacgaccagtacatcttcaccggccagcccctgaacaacgacgaggaccacgcccactggacggaggccaagatgctcctggacaacatcaacacccccgaggggatcatcccggcgctgttcgagcccgagcgcgagaagtccgccgccatcgacggcgagtaccggctcaagggcgagtcccgcaagaccttcgtggagctgatgcggcgcggggacctgcccgtctggctcgcccacaaggtggcgagcgagggcatcaagtacaccgaccggaagtggtgcttcgacgggcagcgcaacaaccagatcctggaggagaacatggacgtggagatctggacgaaggagggcgagaagaagaagctgcggccccgctggctcgacgcccgcacctactccgacccgctggccctgaaggagttcaaggacttcgccgccggccgcaagagcatcgcgctcgacctggtcaccgagatcgggcgcgtgccctcccacctggcccaccggacccgcaacgccctcgacaacctggtgatgctgcacacgagcgagcacggcgggcgggcctaccgccacgccgtcgaggagctccccgagaccatggagaccctgctgctcctgggcctgatgatcctcctgaccgggggcgcgatgctgttcctcatcagcggcaaggggatcggcaagacgtccatcgggctgatctgcgtgatcgccagctccggcatgctgtggatggccgagatcccgctccagtggatcgccagcgccatcgtgctggagttcttcatgatggtcctgctcatccccgagcccgagaagcagcggacgccccaggacaaccagctggcgtacgtggtgatcgggatcctgaccctcgccgccatcatcgccgccaacgagatgggcctgctggagaccacgaagcgcgacctcggcatgtccaaggagccgggggtcgtgagccccacctcctacctggacgtggacctgcaccccgcgagcgcctggaccctctacgccgtcgccaccacggtgatcacccccatgctgcggcacaccatcgagaactccaccgcgaacgtgagcctggccgccatcgccaaccaggccgtcgtgctcatgggcctggacaaggggtggccgatctccaagatggacctgggcgtgcccctcctggcgctggggtgctacagccaggtcaaccccctcacgctgaccgccgccgtgctgctcctggtgacccactacgccatcatcggccccggcctgcaggccaaggcgacccgcgaggcccagaagcggacggccgccgggatcatgaagaacccgaccgtcgacggcatcatcaccatcgacctcgaccccgtgatctacgactccaagttcgagaagcagctgggccaggtgatgctgctcgtcctgtgcgccgtgcagctgctcctgatgcgcaccagctgggcgctgtgcgaggccctcacgctggccaccggccccatcaccaccctgtgggagggctcccccgggaagttctggaacacgaccatcgccgtgagcatggcgaacatcttccggggctcctacctcgccggggccggcctggccttcagcatcatgaagtccgtcgggaccggcaagcgcggcaccgggagccagggcgagaccctgggggagaagtggaagaagaagctcaaccagctgagccggaaggagttcgacctgtacaagaagtccggcatcacggaggtggaccgcaccgaggccaaggaggggctcaagcggggcgagaccacccaccacgcggtgagccgcggctccgccaagctgcagtggttcgtcgagcggaacatggtgatcccggaggggcgcgtgatcgacctgggctgcgggcggggcgggtggagctactactgcgccggcctcaagaaggtcacggaggtgcgcggctacaccaagggcgggcccgggcacgaggagcccgtgcccatgtccacctacggctggaacatcgtcaagctgatgagcgggaaggacgtgttctacctgccgcccgagaagtgcgacaccctcctgtgcgacatcggcgagtccagcccctcccccacggtggaggagagccgcaccatccgggtcctgaagatggtggagccgtggctgaagaacaaccagttctgcatcaaggtgctcaacccctacatgcccgccgtcatcgagcacctggagcgcctgcagcggaagcacggcgggatgctcgtgcgcaaccccctgtcccggaacagcacccacgagatgtactggatctccaacggcaccgggaacatcgtgagctccgtcaacatggtgagccgcctgctcctgaaccggttcacgatgacccaccgccggccgaccatcgagaaggacgtggacctgggcgccggcacccgccacgtcaacgcggagcccgagacgcccaacatggacgtgatcggggagcggatccgccggatcaaggaggagcacaactccacctggcactacgacgacgagaacccgtacaagacctgggcctaccacggcagctacgaggtcaaggccaccgggtccgccagcagcatgatcaacggcgtggtgaagctcctgacgaagccctgggacgtcgtgcccatggtgacccagatggccatgaccgacaccacgcccttcgggcagcagcgcgtcttcaaggagaaggtggacacccggaccccgcgccccatgcccggcacccggaaggtgatggagatcacggcggagtggctgtggcgcaccctcggccggaacaagcgcccccgcctgtgcacccgggaggagttcaccaagaaggtccgcacgaacgccgccatgggggccgtgttcaccgaggagaaccagtgggactccgcgaaggccgccgtggaggacgaggagttctggaagctggtcgaccgggagcgcgagctccacaagctgggcaagtgcgggagctgcgtgtacaacatgatgggcaagcgggagaagaagctgggggagttcggcaaggccaagggctcccgcgccatctggtacatgtggctcggggcgcggtacctggagttcgaggccctgggcttcctcaacgaggaccactggttcagccgcgagaactcctacagcggggtggagggcgaggggctgcacaagctgggctacatcctccgggacatctccaagatcccgggcggggccatgtacgccgacgacaccgccggctgggacacccgcatcacggaggacgacctgcacaacgaggagaagatcacccagcagatgaaccccgagcaccggctgctcgcgaacgccatcttcaagctgacctaccagaacaaggtcgtgaaggtgcagcgccccacccccaccgggacggtcatggacatcatcagccggaaggaccagcgcggctccggccaggtggggacctacggcctgaacaccttcaccaacatggaggcccagctcgtgcggcagatggagggggagggcgtcctgagcaaggccgacctggagaacccgcacctccccgagaagaagatcacgcagtggctggagaccaagggggtggagcgcctgaagcggatggccatctccggcgacgactgcgtggtcaagcccatcgacgaccgcttcgcgaacgccctcctggccctgaacgacatgggcaaggtgcggaaggacatcccccagtggcagccgagcaaggggtggcacgactggcagcaggtccccttctgctcccaccacttccacgagctcatcatgaaggacggccgcaagctggtcgtgccctgccggccccaggacgagctgatcgggcgcgcccgcatcagccagggcgccgggtggtccctccgggagaccgcgtgcctgggcaaggcctacgcccagatgtggagcctgatgtacttccaccgccgggacctccgcctggcctccaacgcgatctgcagcgccgtgccggtccactgggtgcccacctcccggacgacctggagcatccacgcccaccaccagtggatgaccaccgaggacatgctgacggtgtggaaccgcgtctggatcgaggacaacccctggatggaggacaagacccccgtgaccacctgggagaacgtgccgtacctcggcaagcgggaggaccagtggtgcgggagcctgatcggcctgacgtcccgcgccacctgggcccagaacatccccaccgcgatccagcaggtccggagcctcatcgggaacgaggagttcctggactacatgccctccatgaagcgcttccggaaggaggaggagagcgagggcgccatctggtga

SEQ ID NO: 10380 - RNA, 9873 nt, synthetic construct
  misc_feature 1..9873: note = derived and/or modified CDS sequence (opt1) from DENV-3__KC425219__SS-prME
  source 1..9873: mol_type = other RNA
accagcctctgcctcatgatgatcctccccgccgccctggcgttccacctcaccagccgggacggggagccgcggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcacggaggtggagcccgaggacatcgactgctggtgcaacctgaccagcacctgggtgacctacgggacgtgcaaccaggccggcgagcggcgccgggacaagcgctccgtggccctcgcgccccacgtgggcatggggctggacacccggacccagacctggatgagcgccgagggcgcctggcgccaggtggagaaggtggagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtcctgaagaaggaggtgtccgagacccagcacgggaccatcctcatcaaggtggagtaccggggcgaggacgcgccgtgcaagatccccttcagcaccgaggacgggcagggcaaggcccacaacggccgcctgatcacggccaaccccgtcgtgaccaagaaggaggagcccgtgaacatcgaggccgagccgcccttcggggagagcaacatcgtcatcggcatcggggacaacgcgctgaagatcaactggtacaagaagggctccagcatcgggaagatgttcgaggccaccgcccggggcgcccgccgcatggccatcctgggcgacaccgcgtgggacttcgggtccgtgggcggggtgctcaacagcctgggcaagatggtccaccagatcttcgggtccgcctacacggccctgttcagcggcgtgtcctgggtgatgaagatcggcatcggggtcctcctgacctggatcggcctgaaccccaagaacaccagcatgtccttcagctgcatcgccatcgggatcatcaccctctacctgggcgccgtggtgcaggcggacatggggtgcgtcatcaactggaagggcaaggagctgaagtgcggctccgggatcttcgtgacgaacgaggtgcacacctggaccgagcagtacaagttccaggccgacagccccaagcggctcgccaccgccatcgccggcgcgtgggagaacggggtctgcggcatccgctccacgacccggatggagaacctgctgtggaagcagatcgccaacgagctcaactacatcctgtgggagaacaacatcaagctgaccgtggtggtcggggacatcatcggcgtgctcgagcagggcaagcgcaccctgacgccgcagcccatggagctgaagtacagctggaagacctgggggaaggccaagatcgtgaccgccgagacccagaactccagcttcatcatcgacggccccaacacgcccgagtgcccgtccgcgagccgggcctggaacgtctgggaggtggaggactacgggttcggcgtgttcaccaccaacatctggctcaagctgcgcgaggtctacacccagctgtgcgaccaccggctcatgtccgccgccgtgaaggacgagcgcgccgtgcacgcggacatgggctactggatcgagagccagaagaacgggagctggaagctggagaaggcctccctgatcgaggtcaagacctgcacgtggcccaagagccacaccctctggtccaacggcgtgctggagagcgacatgatcatccccaagtccctggccgggccgatcagccagcacaaccaccggcccggctaccacacccagaccgccgggccctggcacctcggcaagctggagctggacttcaactactgcgagggcacgaccgtggtcatcaccgagaactgcgggacccgcggcccctccctccggacgaccaccgtgagcgggaagctgatccacgagtggtgctgccgctcctgcaccctgccgcccctccggtacatgggcgaggacgggtgctggtacggcatggagatccgccccatcagcgagaaggaggagaacatggtgaagtccctggtcagcgccggctccgggaaggtggacaacttcacgatgggcgtgctgtgcctcgcgatcctgttcgaggaggtcatgcgggggaagttcggcaagaagcacatgatcgccggggtgttcttcaccttcgtgctgctcctgagcggccagatcacctggcgcgacatggcccacaccctgatcatgatcggctccaacgccagcgaccggatggggatgggcgtcacgtacctcgccctgatcgcgaccttcaagatccagcccttcctggccctcgggttcttcctgcgcaagctgacctcccgggagaacctcctgctgggcgtgggcctcgccatggccaccacgctgcagctgccggaggacatcgagcagatggcgaacgggatcgccctcggcctgatggccctgaagctcatcacccagttcgagacctaccagctgtggaccgccctgatcagcctcacgtgcagcaacaccatgttcaccctgaccgtggcctggcgcacggcgaccctgatcctcgccggggtctccctgctgcccgtgtgccagagctccagcatgcgcaagaccgactggctccccatggccgtcgccgccatgggcgtgcccccgctgcccctgttcatcttctccctcaaggacaccctgaagcggcgcagctggcccctgaacgagggggtgatggcggtcggcctcgtgtccatcctggccagctccctgctccggaacgacgtgcccatggccggcccgctggtcgccgggggcctgctcatcgcctgctacgtgatcacggggaccagcgcggacctgaccgtggagaaggccgccgacatcacctgggaggaggaggccgagcagacgggcgtctcccacaacctgatgatcaccgtggacgacgacgggaccatgcgcatcaaggacgacgagaccgagaacatcctcaccgtgctgctgaagacggccctcctgatcgtcagcggcgtgttcccctactccatccccgcgaccctgctcgtgtggcacacctggcagaagcagacccagcggagcggcgtcctgtgggacgtgccctccccgcccgagacgcagaaggccgagctggaggagggggtgtaccgcatcaagcagcagggcatcttcgggaagacccaggtcggcgtgggggtgcagaaggagggcgtcttccacaccatgtggcacgtgacccggggcgccgtgctcacgtacaacgggaagcgcctggagcccaactgggccagcgtcaagaaggacctgatctcctacggcgggggctggcggctcagcgcgcagtggcagaagggggaggaggtccaggtgatcgccgtcgagcccggcaagaacccgaagaacttccagaccatgcccggcaccttccagaccacgaccggggagatcggcgccatcgccctggacttcaagcccgggacctccggcagcccgatcatcaaccgcgagggcaaggtggtggggctgtacggcaacggggtcgtgaccaagaacggcgggtacgtgagcggcatcgcccagacgaacgcggagcccgacggccccacccccgagctggaggaggagatgttcaagaagcggaacctcaccatcatggacctgcacccggggtccggcaagacccgcaagtacctgcccgccatcgtccgggaggccatcaagcgccggctccgcacgctgatcctggcccccacccgggtggtggccgcggagatggaggaggccctcaaggggctgcccatccgctaccagaccaccgccaccaagagcgagcacacgggccgggagatcgtcgacctgatgtgccacgccaccttcaccatgcgcctcctgtccccggtgcgggtgcccaactacaacctgatcatcatggacgaggcccacttcacggaccccgcgagcatcgccgcccgcgggtacatctccacccgcgtcggcatgggcgaggccgcggccatcttcatgaccgccacgccgcccgggacggccgacgccttcccccagagcaacgcgcccatccaggacgaggagcgggacatccccgagcgctcctggaacagcggcaacgagtggatcaccgacttcgccgggaagaccgtgtggttcgtgccgtccatcaaggccggcaacgacatcgccaactgcctccggaagaacgggaagaaggtcatccagctgagccgcaagaccttcgacacggagtaccagaagaccaagctgaacgactgggacttcgtggtgaccaccgacatctccgagatgggcgccaacttcaaggcggaccgggtcatcgacccccgccggtgcctcaagcccgtgatcctgacggacggccccgagcgcgtgatcctggccgggccgatgcccgtcaccgccgccagcgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgggagaagtccgcggccatcgacggcgagtaccgcctgaagggcgagagccggaagacgttcgtggagctgatgcgccgcggggacctccccgtctggctggcccacaaggtggcctccgagggcatcaagtacaccgaccgcaagtggtgcttcgacgggcagcggaacaaccagatcctggaggagaacatggacgtcgagatctggaccaaggagggcgagaagaagaagctccgcccgcgctggctggacgcccggacctacagcgaccccctggcgctcaaggagttcaaggacttcgccgccggccgcaagtccatcgccctggacctggtgacggagatcgggcgggtgcccagccacctcgcccaccgcacccggaacgcgctggacaacctggtcatgctccacacctccgagcacggcgggcgcgcctaccggcacgccgtggaggagctgccggagaccatggagacgctgctcctgctgggcctcatgatcctgctgaccgggggcgccatgctgttcctgatcagcggcaaggggatcggcaagaccagcatcgggctgatctgcgtgatcgcctccagcggcatgctctggatggcggagatccccctgcagtggatcgcctccgccatcgtcctggagttcttcatgatggtgctcctgatccccgagcccgagaagcagcgcaccccgcaggacaaccagctggcctacgtggtcatcgggatcctcacgctggccgcgatcatcgccgccaacgagatgggcctgctcgagaccaccaagcgggacctgggcatgagcaaggagcccggggtggtgtcccccaccagctacctggacgtcgacctccaccccgcctccgcgtggacgctgtacgccgtggccaccaccgtgatcaccccgatgctgcgccacacgatcgagaacagcaccgccaacgtctccctcgccgcgatcgccaaccaggccgtggtgctgatgggcctggacaaggggtggcccatcagcaagatggacctcggcgtccccctgctggccctcgggtgctactcccaggtgaaccccctgaccctgaccgccgcggtgctcctgctgatcacgcactacgccatcatcggcccgggcctccaggccaaggccacccgggaggcccagaagcgcaccgcggccgggatcatgaagaaccccaccgtcgacggcatcatgacgatcgacctggaccccgtgatctacgacagcaagttcgagaagcagctgggccaggtgatgctcctggtcctgtgcgccgtgcagctcctgctgatgcggacctcctgggccctctgcgaggcgctgaccctggccaccggccccatcacgaccctctgggagggcagcccggggaagttctggaacaccaccatcgccgtgtccatggccaacatcttccgcggcagctacctggccggggcgggcctggccttctccatcatgaagtccgtcgggacgggcaagcggggcaccgggtcccagggcgagaccctcggggagaagtggaagaagaagctgaaccagctgagccgcaaggagttcgacctctacaagaagtccggcatcaccgaggtggaccggaccgaggccaaggaggggctgaagcgcggcgagatcacgcaccacgccgtgtcccggggcagcgccaagctgcagtggttcgtcgagcgcaacatggtgatccccgaggggcgggtgatcgacctcggctgcgggcgcggcgggtggtcctactactgcgcgggcctgaagaaggtcaccgaggtgcgcggctacaccaagggcgggcccgggcacgaggagcccgtgccgatgagcacctacggctggaacatcgtcaagctgatgtccgggaaggacgtgttctacctgccgcccgagaagtgcgacacgctgctgtgcgacatcggcgagagctcccccagcccgaccgtggaggagtcccggaccatccgcgtcctgaagatggtggagccctggctcaagaacaaccagttctgcatcaaggtgctgaacccctacatgcccaccgtcatcgagcacctggagcggctccagcgcaagcacggcgggatgctggtgcggaacccgctgagccgcaactccacgcacgagatgtactggatcagcaacggcaccgggaacatcgtggcctccgtcaacatggtgagccggctcctgctgaaccgcttcaccatgacccaccggcgccccacgatcgagaaggacgtggacctcggcgccggcacccggcacgtcaacgccgagcccgagaccccgaacatggacgtgatcggggagcgcatcaagcggatcaaggaggagcacaactccacctggcactacgacgacgagaacccctacaagacgtgggcctaccacggcagctacgaggtgaaggcgaccgggtccgccagctccatgatcaacggcgtcgtgaagctgctgaccaagccctgggacgtcgtgcccatggtgacccagatggccatgacggacaccaccccgttcgggcagcagcgcgtcttcaaggagaaggtggacacccggacgccccgcagcatgcccggcacccggcgcgtgatgggcatcaccgccgagtggctctggcggaccctggggcgcaacaagaagccccgcctgtgcacgcgggaggagttcaccaagaaggtccgcaccaacgcggccatgggcgccgtgttcaccgaggagaaccagtgggacagcgccaaggccgcggtggaggacgaggacttctggaagctcgtcgaccgggagcgcgagctgcacaagctggggaagtgcggctcctgcgtgtacaacatgatggggaagcgggagaagaagctcggcgagttcggcaaggccaaggggagccgcgccatctggtacatgtggctgggcgcccggtacctggagttcgaggccctcgggttcctgaacgaggaccactggttctcccgcgagaacagctactccggcgtggagggggagggcctgcacaagctcggctacatcctgcgggacatcagcaagatccccggcggggcgatgtacgccgacgacacggccgggtgggacacccgcatcaccgaggacgacctgcacaacgaggagaagatcacccagcagatggaccccgagcaccggcagctcgccaacgccatcttcaagctgacgtaccagaacaaggtcgtgaaggtgcagcgccccacccccaccgggaccgtcatggacatcatctcccggaaggaccagcgcggcagcggccaggtgggcacctacgggctgaacacgttcaccaacatggaggcgcagctcatccggcagatggagggcgagggggtgctgtccaaggccgacctggagaacccgcacctccccgagaagaagatcacccagtggctggagaccaagggcgtcgagcgcctgaagcggatggccatcagcggcgacgactgcgtggtgaagcccatcgacgaccgcttcgccaacgccctcctggcgctgaacgacatggggaaggtccggaaggacatcccccagtggcagccgtccaagggctggcacgactggcagcaggtccccttctgcagccaccacttccacgagctcatcatgaaggacgggcgcaagctggtggtcccctgccggccccaggacgagctgatcggccgcgcccgcatctcccagggggccggctggagcctccgggagacggcctgcctgggcaaggcgtacgcccagatgtggtccctgatgtacttccaccgccgggacctccgcctggccagcaacgccatctgctccgccgtgccggtgcactgggtccccaccagccggaccacctggtccatccacgcgcaccaccagtggatgacgaccgaggacatgctgaccgtgtggaaccgcgtgtggatcgaggacaacccctggatggaggacaagacccccgtcacgacctgggagaacgtgccgtacctcgggaagcgggaggaccagtggtgcggcagcctgatcgggctgaccagccgcgccacctgggcccagaacatccccacggccatccagcaggtccggtccctcatcggcaacgaggagttcctggactacatgcccagcatgaagcgcttccggaaggaggaggagtccgagggggccatctggtga

SEQ ID NO: 10381 - RNA, 9873 nt, synthetic construct
  misc_feature 1..9873: note = derived and/or modified CDS sequence (opt1) from DENV-3__AY858037__SS-prME
  source 1..9873: mol_type = other RNA
accagcctgtgcctcatgatgatgctgcccgtgaccctggccttccacctcacgtcccgcgacggcgagccgcggatgatcgtcgggaagaacgagcgcggcaagagcctgctgttcaagaccgcctccgggatcaacatgtgcaccctcatcgcgatggacctgggcgagatgtgcgacgacaccgtgacgtacaagtgccccctgatcaccgaggtggagcccgaggacatcgactgctggtgcaacctcaccagcacctgggtcacgtacgggacctgcaaccaggccggcgagcaccggcgcgacaagcggtccgtggccctggccccccacgtgggcatggggctggacacccgcgcccagacctggatgagcgcggagggcgcctggcggcaggtcgagaaggtggagacgtgggccttccgccacccggggttcaccatcctcgccctgttcctggcgcactacatcggcacctccctcacccagaaggtggtcatcttcatcctgctgatgctcgtgacgcccagcatgaccatgcggtgcgtgggggtcggcaaccgcgacttcgtggagggcctgtccggggccacctgggtggacgtcgtgctggagcacggcgggtgcgtgaccacgatggccaagaacaagcccaccctcgacatcgagctgcagaagaccgaggccacccagctggccacgctccggaagctgtgcatcgagggcaagatcaccaacgtcaccaccgacagccgctgccccacgcagggcgaggcgatcctgccggaggagcaggaccagaactacgtgtgcaagcacacctacgtggaccgggggtggggcaacgggtgcggcctcttcgggaagggctccctggtcacctgcgccaagttccagtgcctggagagcatcgagggcaaggtggtgcagcacgagaacctcaagtacaccgtcatcatcacggtgcacaccggggaccagcaccaggtcggcaacgagacccagggggtgaccgccgagatcacgccccaggcctccaccgtggaggccatcctgcccgagtacggcaccctggggctcgagtgcagcccccgcaccggcctggacttcaacgagatgatcctgctcaccatgaagaacaaggcgtggatggtccaccggcagtggttcttcgacctgccgctgccctggacgtccggcgccaccaccgagacccccacgtggaacaagaaggagctcctggtgaccttcaagaacgcccacgccaagaagcaggaggtggtcgtgctggggagccaggagggcgccatgcacaccgcgctcaccggggccacggagatccagacctccggcgggaccagcatcttcgccggccacctgaagtgccgcctgaagatggacaagctcgagctgaagggcatgtcctacgccatgtgcagcaacgccttcgtgctgaagaaggaggtcagcgagacccagcacgggacgatcctcatcaaggtggagtacaagggcgaggacgcgccctgcaagatcccgttctccaccgaggacgggcagggcaaggcccacaacggccggctgatcaccgccaaccccgtggtcaccaagaaggaggagcccgtgaacatcgaggccgagcccccgttcggggagagcaacatcatcatcggcatcggggaccgcgcgctgaagatcaactggtacaagaagggctccagcatcgggaagatgttcgaggccacggcccggggcgcccgccggatggccatcctgggcgacaccgcgtgggacttcgggtccgtgggcggggtcctcaacagcctgggcaagatggtgcaccagatcttcgggtccgcctacaccgccctgttcagcggcgtgtcctggatcatgaagatcggcatcggggtcctcctgacctggatcggcctgaacagcaagaacacgtccatgagcttctcctgcatcgtgatcgggatcatcaccctctacctgggcgccgtggtccaggccgacatggggtgcgtgatcaactggaagggcaaggagctgaagtgcggcagcgggatcttcgtgaccaacgaggtccacacctggacggagcagtacaagttccaggcggactcccccaagcgcctcgccaccgccatcgccggcgcctgggagaacggggtgtgcggcatccgcagcaccacccggatggagaacctgctgtggaagcagatcgcgaacgagctcaactacatcctgtgggagaacaacatcaagctgacggtggtcgtgggggacatcatcggcgtgctcgagcagggcaagcgcaccctgaccccccagcccatggagctgaagtactcctggaagacctgggggaaggccaagatcgtcacggccgagacccagaacagctccttcatcatcgacggcccgaacacccccgagtgccccaacgccagccgggcgtggaacgtgtgggaggtggaggactacgggttcggcgtcttcaccacgaacatctggctcaagctgcgcgagatgtacacccagctgtgcgaccaccggctcatgagcgccgccgtgaaggacgagcgcgccgtgcacgccgacatgggctactggatcgagtcccagaagaacgggagctggaagctggagaaggcgtccctgatcgaggtcaagacctgcacctggcccaagagccacaccctctggtccaacggcgtgctggagagcgacatgatcatcccgaagtccctggccgggcccatcagccagcacaactaccggcccggctaccacacgcagaccgccgggccgtggcacctcggcaagctggagctggacttcaactactgcgagggcaccaccgtggtcatcacggagaactgcgggacccgcggcccctccctccggaccaccacggtgagcgggaagctgatccacgagtggtgctgccgctcctgcaccctgccccccctccggtacatgggcgaggacgggtgctggtacggcatggagatccgcccgatcaacgagaaggaggagaacatggtgaagagcctggtctccgccggcagcgggaaggtggacaacttcaccatgggcgtgctgtgcctcgccatcctgttcgaggaggtcatgcgggggaagttcggcaagaagcacatgatcgcgggggtgctgttcaccttcgtgctcctgctgtccggccagatcacgtggcgcgacatggcccggaccctcatcatgatcggcagcaacgcctccgaccgcatggggatgggcgtcacctacctggccctgatcgccaccttcaagatccagcccttcctcgcgctggggttcttcctgcggaagctcacgagccgcgagaacctgctgctcggcgtgggcctggccatggccaccaccctgcagctccccgaggacatcgagcagatggccaacgggatcgcgctgggcctgatggccctcaagctgatcacccagttcgagacgtaccagctgtggaccgccctcgtgagcctgatgtgctccaacaccatcttcaccctgacggtcgcctggcggaccgccaccctcatcctggcggggatcagcctgttccccgtgtgccagtccagctccatgcgcaagaccgactggctcccgatgacggtcgccgccatgggcgtgccccccctgcccctgttcatcttcagcctcaaggacaccctgaagcgccggtcctggccgctgaacgagggggtgatggccgtcggcctcgtgagcatcctggcctccagcctgctccgcaacgacgtgcccatggcgggccccctggtcgccgggggcctgctcatcgcctgctacgtgatcaccgggacctccgccgacctgacggtggagaaggccgcggacgtcacctgggaggaggaggccgagcagaccggcgtgagccacaacctgatgatcaccgtggacgacgacgggacgatgcggatcaaggacgacgagaccgagaacatcctcaccgtcctgctgaagaccgccctcctgatcgtgtccggcatcttcccctacagcatcccggccaccctgctcgtgtggcacacgtggcagaagcagacccagcgctccggcgtcctgtgggacgtgcccagcccccccgagacccagaaggccgagctggaggagggggtgtaccggatcaagcagcagggcatcttcgggaagacccaggtcggcgtgggggtgcagaaggagggcgtcttccacacgatgtggcacgtgacccgcggcgcggtgctcacctacaacgggaagcggctggagccgaactgggcctccgtcaagaaggacctgatcagctacggcgggggctggcgcctctccgcccagtggcagaagggggaggaggtgcaggtgatcgccgtcgagcccggcaagaaccccaagaacttccagaccatgcccggcatcttccagacgaccaccggggagatcggcgcgatcgccctggacttcaagccggggaccagcggcagccccatcatcaaccgggagggcaaggtggtggggctgtacggcaacggggtcgtgacgaagaacggcgggtacgtgtccggcatcgcccagaccaacgccgagcccgacggcccgacccccgagctggaggaggagatgttcaagaagcgcaacctcaccatcatggacctgcaccccgggagcggcaagacgcggaagtacctgcccgccatcgtccgcgaggcgatcaagcggcgcctccggaccctgatcctggccccgacccgcgtggtggccgccgagatggaggaggccctcaaggggctgcccatccggtaccagaccacggcgaccaagtccgagcacaccggcaaggagatcgtcgacctgatgtgccacgccaccttcacgatgcgcctcctgagccccgtgcgggtgcccaactacaacctgatcatcatggacgaggcccacttcaccgacccggcctccatcgccgcgcgcgggtacatcagcacccgggtcggcatgggcgaggccgccgccatcttcatgaccgcgacgccccccgggaccgccgacgccttcccccagtccaacgccccgatccaggacgaggagcgcgacatccccgagcgcagctggaactccggcaacgactggatcaccgacttcgccgggaagaccgtgtggttcgtgcccagcatcaaggcgggcaacgacatcgccaactgcctccggaagaacgggaagaaggtcatccagctgtcccgcaagacgttcgacaccgagtaccagaagaccaagctgaacgactgggacttcgtggtgaccacggacatcagcgagatgggcgccaacttcaaggccgaccgggtcatcgacccccgccggtgcctcaagccggtgatcctgaccgacggccccgagcgcgtgatcctggccgggcccatgcccgtcaccgtggcgtccgccgcccagcggcgcggccgggtggggcgcaacccgcagaaggagaacgaccagtacatcttcaccggccagcccctcaacaacgacgaggaccacgcccactggacggaggccaagatgctgctggacaacatcaacacccccgaggggatcatccccgcgctcttcgagccggagcgggagaagagcgccgccatcgacggcgagtaccgcctgaagggcgagtcccggaagaccttcgtcgagctgatgcgccggggggacctccccgtgtggctggcccacaaggtcgcgagcgagggcatcaagtacaccgaccgcaagtggtgcttcgacggggagcggaacaaccagatcctggaggagaacatggacgtggagatctggaccaaggagggcgagaagaagaagctccgcccccggtggctggacgcccgcacgtactccgaccccctggccctcaaggagttcaaggacttcgccgccggccgcaagagcatcgcgctggacctggtgaccgagatcgggcgggtcccgtcccacctcgcccaccgcacccggaacgccctggacaacctggtgatgctccacaccagcgagcacggcgggcgcgcctaccggcacgccgtggaggagctgcccgagacgatggagaccctgctcctgctgggcctcatgatcctgctgaccgggggcgcgatgctcttcctgatcagcggcaagggggtcggcaagacctccatcgggctgatctgcgtggtggccagctccggcatgctctggatggccgacatccccctgcagtggatcgccagcgccatcgtcctggagttcttcatgatggtgctcctgatcccggagcccgagaagcagcgcacgccccaggacaaccagctggcgtacgtggtcatcgggatcctcaccctggccgccatcgtggccgccaacgagatgggcctgctcgagaccaccaagcgggacctgggcatgtccaaggagcccggggtggtcagcccgacgtcctacctggacgtggacctccaccccgcgagcgcctggaccctgtacgccgtggccaccaccgtcatcacgcccatgctgcgccacaccatcgagaactccaccgcgaacgtgagcctcgccgccatcgccaaccaggccgtggtcctgatgggcctggacaaggggtggcccatctccaagatggacctcggcgtgccgctgctggcgctcgggtgctacagccaggtgaaccccctgaccctgacggccgccgtcctcctgctggtgacccactacgccatcatcggccccggcctccaggccaaggcgacccgggaggcccagaagcgcaccgccgccgggatcatgaagaaccccacggtggacggcatcatgaccatcgacctggacccggtcatctacgactccaagttcgagaagcagctggggcaggtgatgctcctggtgctgtgcgccgtccagctcctgctgatgcggaccagctgggcgttctgcgaggccctcaccctggccacgggccccatcaccaccctgtgggagggctcccccgggaagttctggaacaccacgatcgccgtgagcatggcgaacatcttccgcggctcctacctcgccggggccggcctggccttcagcatcatgaagtccgtggggaccggcaagcggggcaccgggagccagggcgagaccctgggggagaagtggaagaagaagctcaaccagctgagccgcaaggagttcgacctgtacaagaagtccggcatcacggaggtcgaccggaccgaggccaaggaggggctcaagcgcggcgagatcacccaccacgcggtgagccggggctccgccaagctgcagtggttcgtggagcgcaacatggtcatccccgaggggcgggtgatcgacctgggctgcgggcgcggcgggtggagctactactgcgccggcctcaagaaggtgaccgaggtccggggctacaccaaggggggcccggggcacgaggagcccgtgcccatgtccacgtacggctggaacatcgtgaagctgatgagcgggaaggacgtcttctacctgcccccggagaagtgcgacaccctcctgtgcgacatcggcgagtccagcccctcccccaccgtggaggagagccgcaccatccgcgtgctgaagatggtcgagccctggctgaagaacaaccagttctgcatcaaggtgctcaacccgtacatgcccacggtgatcgagcacctggagcggctgcagcgcaagcacggcgggatgctcgtccggaaccccctgtcccgcaacagcacccacgagatgtactggatctccaacggcaccgggaacatcgtgagctccgtgaacatggtcagccggctgctcctgaaccgcttcaccatgacgtaccggcgccccaccatcgagaaggacgtggacctgggcgccggcacccggcacgtcaacgccgagccggagacccccaacatggacgtgatcggggagcgcatccggcgcatcaaggaggagcactccagcacgtggcactacgacgacgagaacccctacaagacctgggcgtaccacggctcctacgaggtgaaggccaccgggagcgccagctccatgatcaacggcgtcgtgaagctcctgaccaagccgtgggacgtggtccccacggtgacccagatggccatgaccgacaccacgcccttcgggcagcagcgggtgttcaaggagaaggtcgacacccgcacccccaagccgatgcccggcacccggaaggtgatggagatcacggccgagtggctgtggcgcaccctcggccggaacaagcgcccccggctgtgcacccgcgaggagttcaccaagaaggtgcgcacgaacgcggccatgggggccgtcttcaccgaggagaaccagtgggacagcgcccgggcggccgtggaggacgaggagttctggaagctggtggaccgcgagcgggagctccacaagctgggcaagtgcgggtcctgcgtctacaacatgatgggcaagcgcgagaagaagctgggggagttcggcaaggccaagggcagccgggccatctggtacatgtggctcggggcccgctacctggagttcgaggcgctgggcttcctcaacgaggaccactggttctcccgggagaacagctactccggggtggagggcgaggggctgcacaagctgggctacatcctccgcgacatcagcaagatccccggcggggccatgtacgccgacgacaccgccggctgggacacccggatcacggaggacgacctgcacaacgaggagaagatcacccagcagatggacccggagcaccgccagctggccaacgcgatcttcaagctcacctaccagaacaaggtggtcaaggtgcagcggcccacccccaaggggacggtgatggacatcatctcccgcaaggaccagcggggcagcggccaggtcgggacctacggcctgaacaccttcaccaacatggaggcccagctgatccgccagatggagggggagggcgtgctctccaagaccgacctggagaacccccacctgctcgagaagaagatcacgcagtggctggagaccaagggggtggagcggctgaagcgcatggccatcagcggcgacgactgcgtcgtgaagccgatcgacgaccggttcgccaacgccctcctggcgctgaacgacatgggcaaggtgcgcaaggacatcccccagtggcagccctccaaggggtggcacgactggcagcaggtccccttctgcagccaccacttccacgagctcatcatgaaggacggccggaagctggtggtgccgtgccgcccccaggacgagctgatcgggcgggcccgcatctcccagggcgccgggtggagcctcaaggagaccgcctgcctgggcaaggcctacgcgcagatgtgggccctgatgtacttccaccgccgggacctccgcctggcctccaacgccatctgcagcgcggtccccgtgcactgggtgcccacctcccggacgacctggagcatccacgcccaccaccagtggatgaccaccgaggacatgctgacggtctggaaccgcgtgtggatcgaggacaacccgtggatggaggacaagacccccgtgaccacctgggaggacgtcccctacctcggcaagcgggaggaccagtggtgcgggagcctgatcggcctgacgtcccgcgccacctgggcccagaacatcctcaccgccatccagcaggtgcggagcctgatcgggaacgaggagttcctggactacatgccctccatgaagcgcttccggaaggaggaggagagcgagggcgcgatctggtga

SEQ ID NO: 10382 - RNA, 9873 nt, synthetic construct
  misc_feature 1..9873: note = derived and/or modified CDS sequence (opt1) from DENV-3__KJ737429__SS-prME
  source 1..9873: mol_type = other RNA
accagcctgtgcctcatgatgatgctgcccgccaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtgacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccgacagccgctgccccacgcagggcgaggccatcctcccggaggagcaggaccagaactacgtgtgcaagcacacctacgtcgaccgggggtggggcaacgggtgcggcctgttcgggaagggctccctggtgacctgcgccaagttccagtgcctcgagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctgcccgagtacggcaccctcgggctggagtgctccccgcgcaccggcctggacttcaacgagatgatcctcctgaccatgaagaacaaggcgtggatggtccaccggcagtggttcttcgacctgcccctcccctggacgagcggcgccaccaccgagacccccacgtggaaccgcaaggagctgctggtgaccttcaagaacgcccacgccaagaagcaggaggtggtcgtgctcgggtcccaggagggcgccatgcacaccgcgctgaccggggccacggagatccagaacagcggcgggacctccatcttcgccggccacctgaagtgccggctcaagatggacaagctggagctgaagggcatgagctacgccatgtgcctcaacaccttcgtgctgaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctcaagatcaactggtacaagaagggctccagcatcgggaagatgttcgaggcgacggcccggggcgcccgccggatggccatcctgggcgacaccgcctgggacttcgggtccgtcggcggggtgctgaacagcctcggcaagatggtgcaccagatcttcgggtccgcgtacaccgccctgttcagcggcgtctcctggatcatgaagatcggcatcggggtgctgctcacctggatcggcctgaacagcaagaacacgtccatgagcttctcctgcatcgtgatcgggatcatcaccctgtacctcggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctcctgtggaagcagatcgccaacgagctgaactacatcctctgggagaacaacatcaagctgacggtcgtggtgggggacatcatcggcgtcctggagcagggcaagcgcaccctcacgccccagccgatggagctgaagtactcctggaagacctgggggaaggcgaagatcgtgacggccgagacccagaacagctccttcatcatcgacggccccaacacccccgagtgccccagcgcctcccgggcctggaacgtgtgggaggtcgaggactacgggttcggcgtgttcaccacgaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacaccctctggtccaacggcgtgctggagagcgacatgatcatccccaagtccctggcggggcccatcagccagcacaaccaccggccgggctaccacacgcagaccgccgggccctggcacctcggcaagctggagctggacttcaactactgcgagggcaccaccgtcgtgatcacggagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgccggggtgctgttcaccttcgtcctcctgctgtccggccagatcacgtggcgcgacatggcgcacaccctcatcatgatcggcagcaacgcctccgaccggatggggatgggcgtgacctacctggccctgatcgccaccttcaagatccagcccttcctcgccctggggttcttcctgcgcaagctcacgagccgggagaacctgctgctcggcgtgggcctggcgatggccaccaccctgcagctccccgaggacatcgagcagatggccaacgggatcgccctgggcctgatgaccctcaagctgatcacgcagttcgagacctaccagctgtggaccgcgctcgtcagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggccgcgatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccgggggcctcctgatcgcgtgctacgtgatcacggggacctccgccgacctgaccgtcgagaaggccgccgacgtgacctgggaggaggaggccgagcagacgggcgtgagccacaacctcatgatcaccgtcgacgacgacgggaccatgcgcatcaaggacgacgagaccgagaacatcctgaccgtgctgctcaagacggcgctgctgatcgtgtccggcatcttcccctacagcatccccgccaccctcctggtctggcacacctggcagaagcagacccagcggtccggcgtgctgtgggacgtgcccagcccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggcctccgtgaagaaggacctcatcagctacggcgggggctggcggctgtccgcgcagtggcagaagggggaggaggtgcaggtcatcgccgtggagcccggcaagaacccgaagaacttccagaccatgcccggcatcttccagaccaccacgggggagatcggcgccatcgccctggacttcaagcccgggaccagcggcagcccgatcatcaaccgcgagggcaaggtggtcgggctgtacggcaacggggtggtgaccaagaacggcgggtacgtctccggcatcgcgcagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcccccacgcgggtggtcgcggccgagatggaggaggccctgaaggggctgcccatccgctaccagaccaccgccaccaagtccgagcacacgggccgggagatcgtggacctcatgtgccacgccaccttcaccatgcgcctgctgagcccggtgcgggtccccaactacaacctcatcatcatggacgaggcgcacttcaccgaccccgcctccatcgccgcccgcgggtacatcagcacgcgggtgggcatgggcgaggccgcggccatcttcatgaccgccacgccgcccgggaccgccgaggcgttcccccagtccaacgcccccatccaggacgaggagcgcgacatccccgagcgcagctggaactccggcaacgagtggatcacggacttcgtggggaagaccgtctggttcgtgcccagcatcaaggccggcaacgacatcgccaactgcctgcggaagaacgggaagaaggtgatccagctgtcccgcaagaccttcgacaccgagtaccagaagacgcggctcaacgactgggacttcgtcgtgaccaccgacatcagcgagatgggcgccaacttcaaggcggaccgcgtgatcgacccccggcgctgcctgaagcccgtcatcctgaccgacggccccgagcgggtgatcctcgccgggccgatgcccgtgacggccgcctccgccgcgcagcgccggggccgcgtcgggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgccgcgatcgacggcgagtaccggctgaagggcgagtcccgcaagaccttcgtggagctcatgcggcgcggggacctgcccgtctggctggcccacaaggtggccagcgagggcatcaagtacacggaccggaagtggtgcttcgacggggagcgcaacaaccagatcctcgaggagaacatggacgtggagatctggaccaaggagggcgagcggaagaagctgcgcccgcgctggctggacgcccggacctactccgaccccctcgcgctgaaggagttcaaggacttcgccgccggccgcaagagcatcgccctggacctcgtcaccgagatcgggcgggtgccctcccacctggcccaccgcacgcggaacgcgctggacaacctcgtgatgctgcacaccagcgagcacggcgggcgcgcctaccggcacgccgtcgaggagctgccggagaccatggagaccctcctgctgctcggcctgatgatcctgctcaccggcggggccatgctgttcctgatcagcgggaaggggatcggcaagacctccatcgggctcatctgcgtgatcgtgagctccggcatgctgtggatggccgacgtccccctgcagtggatcgcgagcgccatcgtgctcgagttcttcatgatggtgctgctgatccccgagcccgagaagcagcgcaccccgcaggacaaccagctcgcctacgtcgtgatcgggatcctgaccctggccgccatcgtggcggccaacgagatgggcctcctggagacgaccaagcgggacctgggcatgtccaaggagcccggggtcgtgagccccacctcctacctcgacgtggacctgcaccccgccagcgcctggaccctgtacgccgtcgcgacgaccgtgatcaccccgatgctccgccacaccatcgagaactccacggccaacgtgagcctggccgccatcgcgaaccaggccgtcgtgctgatgggcctcgacaaggggtggcccatctccaagatggacctgggcgtgcccctgctcgccctggggtgctacagccaggtcaaccccctgaccctcaccgccgccgtgctgctgctcgtgacccactacgcgatcatcggcccgggcctgcaggccaaggccacgcgggaggcccagaagcgcaccgccgcggggatcatgaagaaccccaccgtcgacggcatcatgaccatcgacctggaccccgtgatctacgactccaagttcgagaagcagctcggccaggtgatgctgctggtcctctgcgccgtgcagctgctgctcatgcggacgagctgggccctgtgcgaggccctgaccctcgccaccggccccatcaccacgctgtgggagggctccccggggaagttctggaacaccaccatcgcggtgagcatggccaacatcttccgcggctcctacctggccggggccggcctcgcgttcagcatcatgaagtccgtcgggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtgagccgcggctccgccaagctccagtggttcgtcgagcggaacatggtgatccccgaggggcgcgtgatcgacctgggctgcgggcgcggcgggtggagctactactgcgccggcctgaagaaggtcaccgaggtgcggggctacaccaagggcgggcccgggcacgaggagcccgtgccgatgtccacctacggctggaacatcgtcaagctcatgagcgggaaggacgtgttctacctgccgcccgagaagtgcgacacgctgctgtgcgacatcggcgagtccagcccctccccgaccgtggaggagagccgcaccatccgggtcctcaagatggtggagccctggctgaagaacaaccagttctgcatcaaggtgctgaacccctacatgcccaccgtcatcgagcacctcgagcgcctgcagcggaagtacggcgggatgctggtgcgcaacccgctctcccggaacagcacgcacgagatgtactggatctccaacggcaccgggaacatcgtgagctccgtcaacatggtgagccgcctgctgctcaaccggttcaccatgacccaccgccggcccacgatcgagaaggacgtcgacctgggcgcgggcacccgccacgtgaacgccgagcccgagaccccgaacatggacgtgatcggggagcggatcaagcgcatcaaggaggagcactccagcacctggcactacgacgacgagaacccctacaagacgtgggcctaccacggctcctacgaggtcaaggccaccgggagcgccagctccatgatcaacggcgtggtgaagctgctcaccaagccctgggacgtcgtgcccatggtgacccagatggcgatgacggacaccaccccgttcgggcagcagcgggtcttcaaggagaaggtggacacccgcacgccccggcccatgcccggcacccgcaaggtgatggagatcaccgccgagtggctgtggcggaccctgggccgcaacaagaagccgcgcctctgcacgcgggaggagttcaccaagaaggtccgcaccaacgccgccatgggggccgtgttcaccgaggagaaccagtgggacagcgcgcgggccgccgtggaggacgaggagttctggaagctggtcgaccgcgagcgggagctgcacaagctcggcaagtgcgggtcctgcgtgtacaacatgatgggcaagcgcgagaagaagctgggggagttcggcaaggccaagggcagccgggcgatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatccccggcggggccatgtacgccgacgacacggcgggctgggacacccggatcaccgaggacgacctccacaacgaggagaagatcacccagcagatggaccccgagcaccgccagctggccaacgccatcttcaagctgacgtaccagaacaaggtcgtgaaggtgcagcggcccaccccgaaggggaccgtcatggacatcatctcccgcaaggaccagcggggcagcggccaggtggggacctacggcctcaacaccttcacgaacatggaggcccagctggtgcgccagatggagggggagggcgtcctgtccaaggccgacctcgagaacccccacctcctggagaagaagatcacccagtggctcgagaccaagggggtggagcggctgaagcgcatggcgatcagcggcgacgactgcgtggtcaagcccatcgacgaccggttcgccaacgccctgctcgccctgaacgacatgggcaaggtgcgcaaggacatcccccagtggcagccgtccaaggggtggcacgactggcagcaggtccccttctgcagccaccacttccacgagctgatcatgaaggacggccggaagctcgtcgtgccctgccgcccccaggacgagctgatcgggcgcgcccggatctcccagggcgcggggtggagcctgaaggagaccgcctgcctcggcaaggcctacgcccagatgtggtccctgatgtacttccaccgccgggacctgcgcctcgccagcaacgcgatctgctccgccgtgccggtccactgggtgcccacgagccggaccacctggagcatccacgcccaccaccagtggatgaccacggaggacatgctgaccgtgtggaaccgcgtctggatcgaggacaacccctggatggaggacaagacccccgtgaccacgtgggaggacgtgccgtacctgggcaagcgggaggaccagtggtgcgggtccctcatcggcctgaccagccgcgccacctgggcgcagaacatcctgaccgccatccagcaggtccggtccctcatcggggacgaggagttcctggactacatgcccagcatgaagcgcttccggaaggaggaggagtccgagggcgccatctggtga

SEQ ID NO: 10383 - RNA, 9873 nt, synthetic construct
  misc_feature 1..9873: note = derived and/or modified CDS sequence (opt1) from DENV-3__DQ863638__SS-prME
  source 1..9873: mol_type = other RNA
accagcctgtgcctcatgatgatgctgcccgcgaccctggccttccacctcaccagccgggacggcgagccccggatgatcgtggggaagaacgagcggggcaagagcctgctgttcaagaccgcgagcgggatcaacatgtgcaccctcatcgccatggacctgggcgagatgtgcgacgacaccgtgacctacaagtgcccccacatcgccgaggtggagcccgaggacatcgactgctggtgcaacctgaccagcacctgggtgacctacgggacgtgcaaccaggccggcgagcaccggcgcgacaagcggtccgtggccctcgcgccccacgtgggcatggggctggacacccgcacccagacctggatgagcgccgagggcgcctggcgccaggtggagaaggtcgagacgtgggccctgcgccaccccgggttcaccatcctcgcgctgttcctggcccactacatcggcacctccctcacccagaaggtggtgatcttcatcctgctgatcctcgtcacgcccagcatggccatgcggtgcgtgggggtgggcaaccgcgacttcgtcgagggcctgtccggggccacctgggtggacgtggtcctggagcacggcgggtgcgtgaccaccatggccaagaacaagcccacgctcgacatcgagctgcagaagaccgaggcgacccagctggccaccctccggaagctgtgcatcgagggcaagatcacgaacatcaccaccgacagccgctgccccacccagggcgaggccatcctgcccgaggagcaggaccagaactacgtgtgcaagcacacgtacgtcgaccgggggtggggcaacgggtgcggcctcttcgggaagggctccctggtgacctgcgccaagttccagtgcctggagagcatcgagggcaaggtggtccagcacgagaacctcaagtacaccgtgatcatcaccgtgcacacgggggaccagcaccaggtcggcaacgagacccagggggtgaccgccgagatcacgccccaggcgtccacggtcgaggccatcctgcccgagtacggcaccctggggctcgagtgcagcccccgcaccggcctggacttcaacgagatgatcctgctcaccatgaagaacaaggcctggatggtgcaccggcagtggttcttcgacctgccgctgccctggacctccggcgccacgaccgagacccccacctggaaccgcaaggagctcctggtgacgttcaagaacgcccacgcgaagaagcaggaggtcgtggtgctggggagccaggagggcgccatgcacaccgccctcaccggggccaccgagatccagaactccggcgggacgagcatcttcgccggccacctgaagtgccggctgaagatggacaagctcgagctgaagggcatgtcctacgcgatgtgcctgaacaccttcgtcctcaagaaggaggtgagcgagacccagcacgggaccatcctgatcaaggtggagtacaagggcgaggacgccccctgcaagatcccgttcagcacggaggacgggcagggcaaggcccacaacggccgcctgatcaccgccaaccccgtcgtgaccaagaaggaggagcccgtgaacatcgaggcggagcccccgttcggggagtccaacatcgtcatcggcatcggggacaaggccctgaagatcaactggtacaagaagggcagctccatcgggaagatgttcgaggccaccgcccggggcgcccgccggatggcgatcctcggcgacacggcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacaccagcatgtccttcagctgcatcgccatcgggatcatcacgctgtacctgggcgcggtcgtgcaggccgacatggggtgcgtgatcaactggaagggcaaggagctcaagtgcggctccgggatcttcgtcaccaacgaggtgcacacctggaccgagcagtacaagttccaggccgacagccccaagcgcctggccacggccatcgcgggcgcctgggagaacggggtgtgcggcatccgctccaccacccggatggagaacctgctctggaagcagatcgccaacgagctgaactacatcctgtgggagaacaacatcaagctcaccgtcgtggtgggggacatcatcggcgtcctggagcagggcaagcgcacgctgacgccccagcccatggagctcaagtacagctggaagacctgggggaaggccaagatcgtgaccgcggagacgcagaactccagcttcatcatcgacggcccgcacacccccgagtgcccccgggcctcccgcgcctggaacgtgtgggaggtcgaggactacgggttcggcgtgttcaccaccaacatctggctgaagctgcgggaggagtacacgcagctctgcgaccaccgcctgatgagcgccgccgtgaaggacgagcgggcggtccacgccgacatgggctactggatcgagagccagaagaacgggtcctggaagctggagaaggccagcctcatcgaggtgaagacctgcacctggcccaagtcccacaccctgtggagcaacggcgtgctggagtccgacatgatcatccccaagagcctcgccgggcccatctcccagcacaaccaccgccccggctaccacacccagacggccgggccgtggcacctgggcaagctggagctcgacttcaactactgcgagggcaccaccgtcgtgatcaccgagaactgcgggacgcggggccccagcctgcgcaccaccaccgtgtccgggaagctgatccacgagtggtgctgccggagctgcacgctgccgcccctccgctacatgggcgaggacgggtgctggtacggcatggagatccggccgatcaacgagaaggaggagaacatggtcaagtccctggcgagcgccggctccgggaaggtggacaacttcaccatgggcttcctctgcctggccatcctgttcgaggaggtgatgcgcgggaagttcggcaagaagcacatgatcgccggggtcttcctcaccttcctgctgctcctgagcggccagatcacctggcgggacatggcccacacgctgatcatgatcggctccaacgcgagcgaccgcatggggatgggcgtgacctacctcgccctgatcgccaccttcaagatccagcccttcctggccctcgggttcttcctgcggaagctgacctcccgcgagaacttcctcctgggcgtgggcctggcgatggccacgaccctccagctgcccgaggacatcgagcagatggccaacgggatcgccctgggcctcatggccctgaagctgatcacccagttcgagacctaccagctctggacggcgctggtcagcctgacctgcagcaacaccatcttcaccctcacggtggcctggcggaccgccaccctgatcctggccggggtgtccctcctgcccgtctgccagagctccagcatgcgcaagaccgactggctgccgatggccgtggcggccatgggcgtgccgcccctgcccctgttcatcttctccctgaaggacacgctcaagcgccggagctggccgctgaacgagggggtcatggccgtgggcctggtctccatcctcgccagctccctgctgcgcaacgacgtgcccatggccggccccctcgtggccggcgggctgctgatcgcctgctacgtcatcaccgggaccagcgccgacctcaccgtggagaaggccgccgacgtgacgtgggaggaggaggcggagcagaccggggtctcccacaacctgatgatcaccgtggacgacgacgggaccatgcggatcaaggacgacgagacggagaacatcctgaccgtgctcctgaagaccgccctgctcatcgtcagcggcatcttcccctactccatcccggccaccctgctggtgtggcacacctggcagaagcagacgcagcgcagcggcgtgctctgggacgtccccagcccgcccgagacccagaaggccgagctggaggagggggtgtaccggatcaagcagcagggcatcttcgggaagacccaggtgggcgtcggggtgcagaaggagggcgtgttccacaccatgtggcacgtcacgcgcggcgcggtgctgacccacaacgggaagcggctcgagccgaactgggccagcgtgaagaaggacctgatctcctacggcgggggctggcgcctgagcgcccagtggcagaagggggaggaggtccaggtgatcgccgtggagcccggcaagaaccccaagaacttccagaccatgcccggcatcttccagaccacgaccggggagatcggcgccatcgcgctggacttcaagccggggacctccggcagccccatcatcaaccgggagggcaaggtcgtggggctctacggcaacggggtggtcaccaagaacggcgggtacgtgagcggcatcgcccagacgaacgccgagcccgacggcccgacccccgagctggaggaggagatgttcaagaagcgcaacctgaccatcatggacctccaccccgggtccggcaagacccggaagtacctgcccgccatcgtgcgcgaggccatcaagcggcgcctgcggacgctcatcctggcgccgacccgcgtcgtggccgccgagatggaggaggccctgaaggggctccccatccggtaccagaccaccgccaccaagtccgagcacaccggccgcgagatcgtggacctgatgtgccacgcgaccttcaccatgcggctgctctcccccgtccgcgtgcccaactacaacctgatcatcatggacgaggcccacttcacggacccggccagcatcgccgcgcgggggtacatctccacccgcgtgggcatgggcgaggccgccgccatcttcatgaccgccacgccgcccgggacggcggacgccttcccccagagcaacgccccgatccaggacgaggagcgcgacatccccgagcggtcctggaacagcggcaacgagtggatcaccgacttcgtcgggaagaccgtgtggttcgtgccctccatcaaggccggcaacgacatcgccaactgcctgcgcaagaacgggaagaaggtcatccagctcagccggaagaccttcgacacggagtaccagaagaccaagctgaacgactgggacttcgtggtgaccaccgacatctccgagatgggcgcgaacttcaaggccgaccgcgtcatcgacccccggcgctgcctgaagccggtgatcctcacggacggccccgagcgggtgatcctggccgggcccatgcccgtcaccgccgccagcgcggcccagcgccggggccgcgtggggcggaacccgcagaaggagaacgaccagtacatcttccgcggccagcccctgaacaacgacgaggaccacgcccactggaccgaggccaagatgctcctggacaacatcaacacccccgaggggatcatccccgcgctgttcgagccggagcgggagaagtccgccgccatcgacggcgagtaccgcctcaagggcgagagccggaagacgttcgtggagctgatgcgccgcggggacctgcccgtctggctcgcccacaaggtggcctccgagggcatcaagtacaccgaccgcaagtggtgcttcgacggggagcggaacaaccagatcctggaggagaacatggacgtggagatctggaccaaggagggcgagaagaagaagctgcgcccccgctggctcgacgcgcggacctacagcgaccccctggccctgaaggagttcaaggacttcgccgccggccgcaagtccatcgccctcgacctggtcaccgagatcgggcgggtgccgagccacctggcgcaccgcacgcggaacgccctcgacaacctggtcatgctgcacacctccgagcacggcgggcgcgcctaccggcacgccgtggaggagctccccgagaccatggagaccctgctgctcctgggcctgatgatcctcctgaccggcggggccatgctgttcctcatcagcgggaaggggatcggcaagaccagcatcgggctgatctgcgtgatcgcgtccagcggcatgctgtggatggccgacgtccccctccagtggatcgcctccgccatcgtgctggagttcttcatgatggtgctgctcatcccggagcccgagaagcagcgcacgccccaggacaaccagctggcctacgtcgtgatcgggatcctgaccctcgcggccatcgtggccgccaacgagatgggcctgctggagacgaccaagcgggacctcggcatgagcaaggagcccggggtcgtgtccccgaccagctacctggacgtggacctgcaccccgcgtccgcctggaccctctacgccgtcgccacgaccgtgatcacccccatgctgcgccacaccatcgagaacagcacggccaacgtgtccctggcggccatcgccaaccaggccgtcgtgctcatgggcctggacaaggggtggcccatcagcaagatggacctgggcgtgccgctcctggccctggggtgctactcccaggtcaaccccctcaccctgaccgcggccgtgctgctcctggccacccactacgccatcatcggccccggcctgcaggccaaggcgacgcgggaggcccagaagcgcaccgccgccgggatcaccaagaaccccaccgtggacggcatcatgacgatcgacctcgacccggtcatctacgacagcaagttcgagaagcagctgggccaggtgatgctgctcgtgctgtgcgcggtccagctgctcctgatgcggacctcctgggccctgtgcgaggccctcaccctggccaccggccccatcacgaccctgtgggagggcagccccgggaagttctggaacaccaccatcgccgtgtccatggcgaacatcttccgcggcagctacctcgccggggccggcctggccttctccatcatgaagtccgtggggacgggcaagcggggcaccgggtcccagggcgagaccctgggggagaagtggaagaagaagctcaaccagctgagccgcaaggagttcgacctgtacaagaagtccggcatcaccgaggtcgaccggacggaggccaaggaggggctcaagcgcggcgagatcacccggcacgcggtgtcccgcggcagcgccaagctgcagtggttcgtggagcggaacatggtcatccccgaggggcgcgtgatcgacctgggctgcgggcgcggcgggtggtcctactactgcgccggcctcaagaaggtgaccgaggtccggggctacaccaagggcggcccggggcacgaggagcccgtgcccatgagcacctacggctggaacatcgtgaagctgatgtccgggaaggacgtcttctacctgcccccggagaagtgcgacacgctgctctgcgacatcggcgagagctcccccagccccaccgtggaggagtcccgcaccatccgggtgctgaagatggtcgagccctggctgaagaacaaccagttctgcatcaaggtgctcaacccgtacatgcccaccgtgatcgagcacctggagcgcctgcagcggaagcacggcgggatgctcgtccgcaaccccctgagccggaactccacgcacgagatgtactggatcagcaacggcaccgggaacatcgtgtccagcgtgaacatggtctcccgcctgctcctgaaccggttcaccatgacccaccgccggcccacgatcgagaaggacgtggacctgggcgccggcacccgccacgtgaacgccgagccggagacccccaacatggacgtcatcggggagcggatcaagcgcatcaaggaggagcacaacagcacctggcactacgacgacgagaacccctacaagacgtgggcgtaccacggctcctacgaggtgaaggccaccgggagcgcctccagcatgatcaacggcgtggtcaagctcctgaccaagccgtgggacgtggtccccatggtgatccagatggccatgaccgacacgacccccttcgggcagcagcgggtgttcaaggagaaggtcgacacccgcacgccccggccgatgcccggcacccgcaaggtgatggagatcaccgcggagtggctgtggcggaccctcggccgcaacaagcgcccccggctgtgcacccgcgaggagttcacgaagaaggtgcggaccaacgccgccatgggggccgtcttcaccgaggagaaccagtgggacagcgcccgcgcggccgtggaggacgaggagttctggaagctggtggaccgggagcgcgagctccacaagctgggcaagtgcgggtcctgcgtctacaacatgatgggcaagcgggagaagaagctgggggagttcggcaaggccaagggcagccgcgccatctggtacatgtggctcggggcccggtacctggagttcgaggcgctgggcttcttcaacgaggaccactggttctcccgcgagaacagctactccggggtggagggcgaggggctccacaagctgggctacatcctgcgggacatcagcaagatccccggcggggccatgtacgccgacgacaccgccggctgggacacgcgcatcaccgaggacgacctccacaacgaggagaagatcacccagcagatggacccggagcaccggcagctggccaacgcgatcttcaagctgacctaccagaacaaggtggtcaaggtgcagcgccccacgcccaaggggaccgtgatggacatcatctcccggaaggaccagcgcggcagcggccaggtcgggacctacggcctcaacaccttcacgaacatggaggcccagctggtgcggcagatggagggggagggcgtgctgtccaaggccgacctcgagaacccccacctcctggagaagaagatcacccagtggctcgagaccaagggggtcgagcgcctgaagcggatggccatcagcggcgacgactgcgtggtgaagccgatcgacgaccgcttcgccaacgcgctgctcgccctgaacgacatgggcaaggtccggaaggacatcccccagtggcagccctccaaggggtggcacgactggcagcaggtccccttctgcagccaccacttccacgagctgatcatgaaggacggccgcaagctcgtggtcccgtgccgcccccaggacgagctgatcgggcgggcccgcatctcccggggcgccgggtggagcctgaaggagaccgcgtgcctcggcaaggcctacgcccagatgtggtccctgatgtacttccaccgccgggacctgcgcctcgccagcaacgccatctgctccgcggtgcccgtgcactgggtccccaccagccggacgacctggtccatccacgcccaccaccagtggatgaccaccgaggacatgctgacggtgtggaaccgcgtgtggatcgaggacaacccgtggatggaggacaagacccccgtcaccacctgggaggacgtgccctacctgggcaagcgggaggaccagtggtgcgggagcctcatcggcctgacgagccgcgccacctgggcccagaacatcctgaccgccatccagcaggtccggtccctcatcgggaacgaggagttcctggactacatgcccagcatgaagcgcttcaagaaggaggaggagtccgagggcgcgatctggtga

SEQ ID NO: 10384 - RNA, 9873 nt, synthetic construct
  misc_feature 1..9873: note = derived and/or modified CDS sequence (opt1) from DENV-3__KJ737430__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcggcaggtggagaaggtcgagacgtgggccctccgccacccggggttcaccatcctggcgctgttcctcgcccactacatcggcacctccctgacccagaaggtggtgatcttcatcctgctcatgctggtcacgcccagcatggccatgcggtgcgtgggggtgggcaaccgcgacttcgtcgagggcctgtccggggccacctgggtggacgtggtcctcgagcacggcgggtgcgtgaccaccatggccaagaacaagcccacgctggacatcgagctgcagaagaccgaggcgacccagctcgccaccctgcggaagctgtgcatcgagggcaagatcacgaacatcaccaccgacagccgctgccccacccagggcgaggccatcctcccggaggagcaggaccagaactacgtgtgcaagcacacgtacgtcgaccgggggtggggcaacgggtgcggcctgttcgggaagggctccctggtgacctgcgccaagttccagtgcctcgagagcatcgagggcaaggtggtccagcacgagaacctgaagtacaccgtgatcatcaccgtgcacacgggggaccagcaccaggtcggcaacgacacccagggggtgaccgtcgagatcaccccccaggcctccacggtggaggcgatcctgcccgagtacggcaccctcgggctggagtgcagcccccgcaccggcctggacttcaacgagatgatcctcctgaccatgaagaacaaggcctggatggtgcaccggcagtggttcttcgacctgccgctcccctggacctccggcgccacgaccgagacccccacctggaaccgcaaggagctgctggtcacgttcaagaacgcccacgccaagaagcaggaggtggtggtcctcgggagccaggagggcgcgatgcacaccgccctgaccggggccaccgagatccagaactccggcgggacgagcatcttcgccggccacctgaagtgccggctcaagatggacaagctggagctgaagggcatgtcctacgccatgtgcctcaacaccttcgtgctgaagaaggaggtgagcgagacccagcacgggaccatcctgatcaaggtcgagtacaagggcgaggacgcgccctgcaagatcccgttcagcacggaggacgggcagggcaaggcccacaacggccgcctgatcaccgccaaccccgtggtgaccaagaaggaggagcccgtcaacatcgaggccgagcccccgttcggggagtccaacatcgtgatcggcatcggggacaaggcgctcaagatcaactggtacaagaagggcagctccatcgggaagatgttcgaggccaccgcccggggcgcccgccggatggccatcctgggcgacacggcgtgggacttcgggagcgtgggcggggtcctgaactccctcggcaagatggtgcaccagatcttcgggagcgcctacaccgccctgttctccggcgtgagctggatcatgaagatcggcatcggggtcctgctcacctggatcggcctgaactccaagaacaccagcatgtccttcagctgcatcgccatcgggatcatcacgctgtacctcggcgccgtggtgcaggcggacatggggtgcgtcatcaactggaagggcaaggagctgaagtgcggctccgggatcttcgtgaccaacgaggtgcacacctggaccgagcagtacaagttccaggccgacagccccaagcgcctggccacggccatcgccggcgcgtgggagaacggggtctgcggcatccgctccaccacccggatggagaacctcctgtggaagcagatcgccaacgagctgaactacatcctctgggagaacaacatcaagctgaccgtggtggtcggggacatcatcggcgtgctggagcagggcaagcgcacgctcaccccccagcccatggagctgaagtacagctggaagacctgggggaaggccaagatcgtgaccgccgagacgcagaactccagcttcatcatcgacggcccgaacacccccgagtgcccctccgcgagccgggcctggaacgtctgggaggtggaggactacgggttcggcgtgttcaccaccaacatctggctgaagctccgcgaggtctacacgcagagctgcgaccaccggctgatgtccgccgccatcaaggacgagcgcgccgtgcacgcggacatgggctactggatcgagagccagaagaacgggtcctggaagctggagaaggccagcttcatcgaggtgaagacctgcacctggcccaagtcccacaccctctggagcaacggcgtcctggagtccgacatgatcatcccgaagagcctggccgggcccatctcccagcacaaccaccggcccggctaccacacccagacggccgggccgtggcacctcggcaagctggagctggacttcaactactgcgagggcaccaccgtggtgatcaccgagaactgcgggacgcgcggccccagcctccggaccaccaccgtctccgggaagctgatccacgagtggtgctgccgcagctgcacgctgccccccctccggtacatgggcgaggacgggtgctggtacggcatggagatccgcccgatcaacgagaaggaggagaacatggtgaagtccctggtgagcgccggctccgggaaggtcgacaacttcaccatgggcgtgctgtgcctcgcgatcctgttcgaggaggtgatgcgggggaagttcggcaagaagcacatgatcgccggggtcctgttcaccttcgtgctcctgctgagcggccagatcacctggcgcgacatggcccacacgctcatcatgatcggctccaacgccagcgaccggatggggatgggcgtgacctacctggccctgatcgcgaccttcaagatccagcccttcctcgccctggggttcttcctgcgcaagctcaccagccgggagaacctgctgctcggcgtcggcctggccatggccacgaccctgcagctccccgaggacatcgagcagatggcgaacgggatcgccctgggcctgatggccctcaagctgatcacccagttcgagacctaccagctgtggacggccctcgtgtccctgacctgcagcaacaccatcttcaccctgacggtggcctggcgcaccgcgaccctcatcctggccggggtctccctgctccccgtgtgccagagctccagcatgcggaagaccgactggctgccgatggccgtcgccgccatgggcgtgccccccctgcccctcttcatcttctccctgaaggacacgctgaagcgccgcagctggccgctcaacgagggggtgatggcggtcggcctggtgtccatcctggccagctccctcctgcggaacgacgtgcccatggccggccccctggtcgccgggggcctcctgatcgcctgctacgtgatcaccgggaccagcgcggacctgaccgtggagaaggccgccgacgtcacgtgggaggaggaggccgagcagaccggcgtgtcccacaacctcatgatcaccgtggacgacgacgggaccatgcgcatcaaggacgacgagacggagaacatcctgaccgtcctgctcaagaccgccctgctgatcgtgagcggcatcttcccctactccatcccggcgaccctcctggtgtggcacacctggcagaagcagacgcagcggagcggcgtcctgtgggacgtgccctccccccccgagacccagaaggccgagctcgaggagggggtgtaccgcatcaagcagcagggcatcttcgggaagacccaggtcggcgtgggggtgcagaaggagggcgtcttccacaccatgtggcacgtgacgcggggcgccgtgctgacccacaacgggaagcgcctggagccgaactgggccagcgtcaagaaggacctcatctcctacggcgggggctggcggctgagcgcgcagtggcagaagggggaggaggtgcaggtgatcgccgtcgagcccggcaagaaccccaagaacttccagaccatgcccggcatcttccagaccacgaccggggagatcggcgccatcgccctggacttcaagccggggaccagcggctcccccatcatcaaccgcgagggcaaggtggtggggctgtacggcaacggggtcgtgaccaagaacggcgggtacgtgagcggcatcgcccagacgaacgcggagcccgacggcccgacccccgagctcgaggaggagatgttcaagaagcggaacctgaccatcatggacctgcaccccgggtccggcaagacccgcaagtacctccccgccatcgtccgggaggccatcaagcgccggctgcgcacgctgatcctcgccccgacccgggtggtggccgcggagatggaggaggccctgaaggggctgcccatccgctaccagaccaccgccacgaagagcgagcacaccggccgggagatcgtcgacctcatgtgccacgccaccttcaccatgcgcctgctgtcccccgtgcgggtgcccaactacaacctcatcatcatggacgaggcccacttcacggacccggcgagcatcgccgcccgcgggtacatctccacccgggtcggcatgggcgaggccgcggccatcttcatgaccgccaccccccccgggacggccgaggccttcccccagagcaacgcgccgatccaggacgaggagcgcgacatccccgagcgctcctggaacagcggcaacgagtggatcaccgacttcgtggggaagaccgtgtggttcgtcccctccatcaaggccggcaacgacatcgccaactgcctgcggaagaacgggaagaaggtgatccagctgagccgcaagaccttcgacacggagtaccagaagaccaagctcaacgactgggacttcgtggtcaccaccgacatctccgagatgggcgccaacttcaaggccgaccgggtgatcgacccccgccggtgcctgaagccggtgatcctgacggacggccccgagcgcgtcatcctcgcggggcccatgcccgtgaccgccgccagcgccgcccagcggcgcggccgggtggggcgcaacccgcagaaggagaacgaccagtacatcttcaccggccagcccctgaacaacgacgaggaccacgcgcactggaccgaggccaagatgctgctcgacaacatcaacacgcccgaggggatcatccccgccctgttcgagccggagcgggagaagtccgccgcgatcgacggcgagtaccgcctgaagggcgagagccggaagaccttcgtcgagctcatgcgccggggggacctgcccgtgtggctggcccacaaggtcgcctccgagggcatcaagtacaccgaccgcaagtggtgcttcgacggggagcggaacaaccagatcctcgaggagaacatggacgtggagatctggaccaaggagggcgagcgcaagaagctgcggccccgctggctggacgcccgcacctacagcgaccccctcgccctgaaggagttcaaggacttcgcggccggccggaagtccatcgccctggacctcgtgacggagatcgggcgcgtcccgagccacctggcccaccggacccgcaacgccctggacaacctcgtgatgctgcacaccagcgagcacggcgggcgggcgtaccgccacgccgtggaggagctgcccgagaccatggagacgctcctgctgctcggcctgatgatcctgctcaccgggggcgccatgctgttcctgatctccggcaaggggatcggcaagaccagcatcgggctcatctgcgtcatcgtgtccagcggcatgctgtggatggccgacgtgcccctgcagtggatcgcctccgcgatcgtcctcgagttcttcatgatggtgctgctgatcccggagcccgagaagcagcggaccccccaggacaaccagctcgcctacgtggtcatcgggatcctgacgctggccgccatcgtggccgcgaacgagatgggcctcctggagaccaccaagcgcgacctgggcatgagcaaggagcccggggtggtctccccgaccagctacctcgacgtggacctgcaccccgcctccgcctggacgctgtacgccgtggcgaccaccgtcatcacccccatgctccggcacacgatcgagaacagcaccgccaacgtgtccctggccgccatcgccaaccaggcggtggtcctgatgggcctcgacaaggggtggcccatcagcaagatggacctgggcgtgccgctgctcgccctggggtgctactcccaggtgaaccccctgaccctcaccgccgccgtcctgctgctcgtgacgcactacgccatcatcggccccggcctgcaggcgaaggccacccgcgaggcccagaagcggaccgccgccgggatcatgaagaaccccaccgtggacggcatcatgacgatcgacctggacccggtcatctacgacagcaagttcgagaagcagctcgggcaggtgatgctgctggtgctctgcgcggtccagctgctgctcatgcgcacctcctgggccctgtgcgaggccctgaccctcgccaccggccccatcacgaccctgtgggagggcagccccgggaagttctggaacaccaccatcgcggtgtccatggccaacatcttccggggcagctacctggccggggccggcctcgccttctccatcatgaagagcgtggggacgggcaagcgcggcaccgggagccagggcgagaccctgggggagaagtggaagaagaagctgaaccagctctcccggaaggagttcgacctgtacaagaagagcggcatcaccgaggtcgaccgcacggaggcgaaggaggggctgaagcggggcgagaccacccaccacgccgtgtcccgcggcagcgccaagctccagtggttcgtggagcggaacatggtcatccccgaggggcgcgtgatcgacctgggctgcgggcggggcgggtggtcctactactgcgccggcctgaagaaggtgaccgaggtccgcggctacaccaaggggggcccggggcacgaggagcccgtgcccatgagcacgtacggctggaacatcgtgaagctcatgtccgggaaggacgtcttctacctgcccccggagaagtgcgacaccctgctgtgcgacatcggcgagagctcccccagccccaccgtggaggagtcccgcaccatccgggtgctcaagatggtcgagccctggctgaagaacaaccagttctgcatcaaggtgctgaacccgtacatgcccacggtgatcgagcacctcgagcgcctgcagcggaagtacggcgggatgctggtccgcaaccccctcagccggaactccacccacgagatgtactggatcagcaacggcaccgggaacatcgtgtccagcgtgaacatggtctcccgcctgctgctcaaccggttcaccatgacgcaccgccggcccaccatcgagaaggacgtggacctgggcgccggcacccgccacgtcaacgcggagccggagacccccaacatggacgtgatcggggagcggatcaagcgcatcaaggaggagcacagctccacgtggcactacgacgacgagaacccctacaagacctgggcctaccacggcagctacgaggtgaaggccaccgggagcgcctccagcatgatcaacggcgtcgtgaagctgctcaccaagccgtgggacgtggtccccatggtgatccagatggccatgacggacaccacccccttcgggcagcagcgggtgttcaaggagaaggtcgacacccgcacgccccggccgatgcccggcacccgcaaggtgatggagatcaccgcggagtggctgtggcggaccctgggccgcaacaagcggccccgcctctgcacgcgcgaggagttcaccaagaaggtgcggaccaacgccgccatgggggccgtcttcaccgaggagaaccagtgggactccgcgcgcgccgccgtggaggacgaggagttctggaagctggtggaccgggagcgcgagctgcacaagctcggcaagtgcgggagctgcgtctacaacatgatgggcaagcgggagaagaagctgggggagttcggcaaggccaagggctcccgcgccatctggtacatgtggctgggggcgcggtacctcgagttcgaggccctgggcttcctgaacgaggaccactggttcagccgcgagaactcctacagcggggtggagggcgaggggctccacaagctgggctacatcctgcgggacatctccaagatccccggcggggccatgtacgccgacgacacggccggctgggacacccgcatcaccgaggacgacctccacaacgaggagaagatcacccagcagatggacccggagcaccggcagctggcgaacgccatcttcaagctgacgtaccagaacaaggtggtcaaggtgcagcgccccacccccaaggggaccgtgatggacatcatcagccggaaggaccagcgcggctccggccaggtcgggacctacggcctcaacacgttcaccaacatggaggcccagctggtgcggcagatggagggggagggcgtgctgagcaaggccgacctcgagaacccccacctgctggagaagaagatcacccagtggctcgagaccaagggggtcgagcgcctgaagcggatggccatctccggcgacgactgcgtggtgaagccgatcgacgaccgcttcgcgaacgccctgctcgccctgaacgacatgggcaaggtccggaaggacatcccccagtggcagcccagcaaggggtggcacgactggcagcaggtgcccttctgctcccaccacttccacgagctgatcatgaaggacggccgcaagctcgtggtcccgtgccggccccaggacgagctgatcgggcgcgcccgcatcagccagggcgccgggtggtccctgaaggagaccgcgtgcctcggcaaggcctacgcccagatgtggagcctgatgtacttccaccggcgcgacctgcggctcgcctccaacgcgatctgcagcgccgtgcccgtgcactgggtccccacgagccgcaccacctggtccatccacgcccaccaccagtggatgaccacggaggacatgctgaccgtgtggaaccgggtgtggatcgaggacaacccgtggatggaggacaagacccccgtcaccacgtgggaggacgtgccctacctgggcaagcgcgaggaccagtggtgcgggagcctcatcggcctgacctcccgggccacctgggcccagaacatcctgaccgcgatccagcaggtgcgcagcctcatcggggacgaggagttcctggactacatgccctccatgaagcggttccgcaaggaggaggagagcgagggcgccatctggtga

SEQ ID NO: 10385 - RNA, 9873 nt, synthetic construct
  misc_feature 1..9873: note = derived and/or modified CDS sequence (opt1) from DENV-3__AY858040__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcgcgcagacctggatgagcgccgagggcgcctggcggcaggtggagaaggtcgagacgtgggccttccgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgctccccccgcaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggcggacatggggtgcgtcatcaactggaagggcaaggagctcaagtgcggctccgggatcttcgtgaccaacgaggtgcacacctggacggagcagtacaagttccaggccgacagccccaagcggctggccaccgccatcgccggcgcgtgggagaacggggtctgcggcatccgctccaccacccgcatggagaacctgctctggaagcagatcgccaacgagctgaactacatcctgtgggagaacaacatcaagctcacggtggtggtcggggacatcatcggcgtgctggagcagggcaagcggaccctgaccccccagcccatggagctcaagtacagctggaagacctgggggaaggccaagatcgtgacggccgagaagcagaactccagcttcatcatcgacggcccgaacacccccgagtgccccaacgcgtcccgcgcctggaacgtctgggaggtggaggactacgggttcggcgtgttcaccaccaacatctggctgaagctgcgggagatgtacacgcagctctgcgaccaccgcctgatgagcgccgccgtcaaggacgagcgggccgtgcacgcggacatgggctactggatcgagagccagaagaacgggtcctggaagctggagaaggccagcctcatcgaggtgaagacctgcacctggcccaagtcccacaccctgtggagcaacggcgtcctggagtccgacatgatcatcccgaagagcctcgccgggcccatctcccagcacaactaccgccccggctaccacacccagacggccgggccgtggcacctgggcaagctggagctcgacttcaactactgcgagggcaccaccgtggtgatcaccgagaactgcgggacgcggggccccagcctgcgcaccaccaccgtctccgggaagctgatccacgagtggtgctgccggagctgcacgctcccccccctgcgctacatgggcgaggacgggtgctggtacggcatggagatccggccgatcaacgagaaggaggagaacatggtgaagtccctggtgagcgccggctccgggaaggtcgacaacttcaccatgggcgtgctctgcctggcgatcctgttcgaggaggtgatgcgcgggaagttcggcaagaagcacatgatcgccggggtcctcttcaccttcgtgctgctgctcagcggccagatcacctggcgggacatggcccgcacgctgatcatgatcggctccaacgccagcgaccggatggggatgggcgtgacctacctggccctcatcgcgaccttcaagatccagcccttcctggccctggggttcttcctccgcaagctgacctcccgggagaacctgctcctgggcgtcggcctggccatggccacgaccctccagctgcccgaggacatcgagcagatggcgaacgggatcgccctgggcctcatggccctgaagctgatcacccagttcgagacctaccagctctggacggccctggtgagcctgatgtgcagcaacaccatcttcaccctcaccgtggcctggcgcacggcgaccctgatcctggccgggatctccctcatgcccgtctgccagagctccagcatgcggaagaccgactggctgccgatgaccgtggccgccatgggcgtcccccccctgcccctcttcatcttctccctgaaggacacgctgaagcgccgcagctggccgctcaacgagggggtgatggccgtgggcctggtctccatcctggcgagctccctcctgcggaacgacgtgcccatggccggccccctggtggccgggggcctcctgatcgcctgctacgtcatcaccgggaccagcgccgacctgaccgtggagaaggcggccgacgtgacgtgggaggaggaggccgagcagaccggcgtctcccacaacctcatgatcaccgtggacgacgacgggaccatgcgcatcaaggacgacgagacggagaacatcctgaccgtgctgctcaagaccgccctgctgatcgtcagcggcatcttcccctactccatcccggccaccctcctggtgtggcacacctggcagaagcagacgcagcggagcggcgtgctgtgggacgtcccctccccccccgagacccagaaggcggagctcgaggagggggtgtaccgcatcaagcagcagggcatcttcgggaagacccaggtgggcgtcggggtgcagaaggagggcgtgttccacaccatgtggcacgtcacgcggggcgccgtgctgacctacaacgggaagcgcctggagccgaactgggccagcgtgaagaaggacctcatctcctacggcgggggctggcggctgagcgcctactggcagaagggggaggaggtccaggtgatcgcggtggagcccggcaagaaccccaagaacttccagaccatgcccggcatcttccagaccacgaccggggagatcggcgccatcgccctggacttcaagccggggacctccggcagccccatcatcaaccgcgagggcaaggtcgtggggctgtacggcaacggggtggtcaccaagaacggcgggtacgtgagcggcatcgcccagacgaacgccgagcccgacggcccgacccccgagctcgaggaggagatgttcaagaagcggaacctgaccatcatggacctgcaccccgggtccggcaagacccgcaagtacctccccgcgatcgtgcgggaggccatcaagcgccggctgcgcacgctgatcctcgccccgacccgggtcgtggccgccgagatggaggaggcgctgaaggggctgcccgtgcgctaccagaccaccgccacgaagagcgagcacaccggcaaggagatcgtcgacctcatgtgccacgccaccttcaccatgcggctgctgtcccccgtgcgcgtgcccaactacaacctcatcatcatggacgaggcccacttcacggacccggccagcatcgcggcccgggggtacatctccacccgcgtcggcatgggcgaggccgccgcgatcttcatgaccgccaccccccccgggacggccgacgccttcccccagagcaacgccccgatccaggacgaggagcgggacatccccgagcgctcctggaacagcggcaacgactggatcaccgacttcgcggggaagaccgtgtggttcgtgccctccatcaaggccggcaacgacatcgccaactgcctgcgcaagaacgggaagaaggtcatccagctgagccggaagaccttcgacacggagtaccagaagaccaagctcaacgactgggacttcgtggtgaccaccgacatctccgagatgggcgccaacttcaaggccgaccgcgtcatcgacccccggcgctgcctgaagccggtgatcctgacggacggccccgagcgggtgatcctcgcggggcccatgcccgtcaccgtggccagcgccgcccagcgccggggccgcgtggggcggaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgcgagaagtccgccgccatcgacggcgagtaccggcccaagggcgagagccgcaagaccttcgtcgagctgatgcggcgcggggacctccccgtgtggctggcgcacaaggtcgcctccgagggcatcaagtacaccgaccggaagtggtgcttcgacggggagcgcaacaaccagatcctggaggagaacatggacgtggagatctggaccaaggagggcgagaagaagaagctccggccccgctggctggacgcccggacctacagcgacccgctggccctcaaggagttcaaggacttcgccgcgggccgcaagtccatcgccctggacctggtgacggagatcgggcgcgtccccagccacctcgcccaccggacccgcaacgccctggacaacctggtgatgctccacacctccgagcacggcgggcgggcctaccgccacgcggtggaggagctgcccgagaccatggagacgctgctcctgctgggcctcatgatcctgctgaccgggggcgccatgctcttcctgatcagcggcaagggggtcggcaagaccagcatcgggctgatctgcgtggtggcctccagcggcatgctctggatggccgacatcccgctgcagtggatcgcctccgcgatcgtcctggagttcttcatgatggtgctcctgatccccgagcccgagaagcagcggaccccccaggacaaccagctggcctacgtggtcatcgggatcctcacgctggccgccatcgtggccgcgaacgagatgggcctgctcgagaccaccaagcgcgacctgggcatgagcaaggagccgggggtggtctcccccaccagctacctggacgtggacctccaccccgcctccgcctggacgctgtacgccgtggcgaccaccgtcatcacccccatgctgcggcacacgatcgagaacagcaccgccaacgtgtccctcgccgccatcgccaaccaggcggtggtcctgatgggcctggacaaggggtggccgatcagcaagatggacctcggcgtgcccctgctggccctcgggtgctactcccaggtgaaccccctgaccctgaccgccgccgtcctcctgctggtgacgcactacgccatcatcggccccggcctccaggcgaaggccacccgcgaggcccagaagcggaccgccgccgggatcatgaagaacccgaccgtggacggcatcatgacgatcgacctggaccccgtcatctacgacagcaagttcgagaagcagctggggcaggtgatgctcctggtgctgtgcgcggtccagctcctgctgatgcgcacctcctgggccttctgcgaggccctcaccctggccaccggccccatcacgaccctgtgggagggcagccccgggaagttctggaacaccaccatcgcggtgtccatggccaacatcttccggggcagctacctcgccggggccggcctggccttctccatcatgaagagcgtggggacgggcaagcgcggcaccgggtcccagggcgagaccctgggggagaagtggaagaagaagctcaaccagctgagccggaaggagttcgacctgtacaagaagagcggcatcaccgaggtcgaccgcacggaggcgaaggaggggctcaagcggggcgagatcacccaccacgccgtgtcccgcggcagcgccaagctgcagtggttcgtggagcggaacatggtcatcccggaggggcgcgtgatcgacctgggctgcgggcggggcgggtggtcctactactgcgccggcctcaagaaggtgaccgaggtccgcggctacaccaaggggggccccgggcacgaggagcccgtgcccatgagcacctacggctggaacatcgtgaagctgatgtccgggaaggacgtcttctacctgccgcccgagaagtgcgacacgctcctgtgcgacatcggcgagagctcccccagccccaccgtggaggagtcccggaccatccgcgtgctgaagatggtcgagccgtggctgaagaacaaccagttctgcatcaaggtgctcaacccctacatgcccaccgtgatcgagcacctggagcgcctgcagcggaagcacggcgggatgctcgtccgcaaccccctgagccggaactccacgcacgagatgtactggatcagcaacggcaccgggaacatcgtgtccagcgtgaacatggtctcccgcctgctcctgaaccggttcaccatgacctaccgccggccgacgatcgagaaggacgtggacctgggcgccggcacccgccacgtcaacgcggagcccgagacccccaacatggacgtgatcggggagcggatccgccggatcaaggaggagcacagctccacctggcactacgacgacgagaacccgtacaagacgtgggcctaccacggcagctacgaggtgaaggccaccgggtccgccagcagcatgatcaacggcgtcgtgaagctcctgaccaagccctgggacgtggtccccaccgtgacgcagatggccatgaccgacaccacccccttcgggcagcagcgcgtgttcaaggagaaggtcgacacgcggaccccgaagcccatgcccggcacccgcaaggtgatggagatcaccgcggagtggctgtggcggacgctcggccgcaacaagcggccccgcctgtgcacccgggaggagttcaccaagaaggtgcgcaccaacgccgccatgggggccgtcttcacggaggagaaccagtgggactccgcgcgcgccgccgtggaggacgaggagttctggaagctggtggaccgggagcgcgagctccacaagctgggcaagtgcgggagctgcgtctacaacatgatgggcaagcgggagaagaagctgggggagttcggcaaggccaagggctcccgcgccatctggtacatgtggctcggggcgcggtacctggagttcgaggccctgggcttcctcaacgaggaccactggttcagccgcgagaactcctacagcggggtggagggcgaggggctgcacaagctgggctacatcctccgggacatctccaagatcccgggcggggccatgtacgccgacgacaccgccggctgggacacccgcatcaccgaggacgacctgcacaacgaggagaagatcacgcagcagatggagcccgagcaccggcagctggcgaacgccatcttcaagctcacctaccagaacaaggtggtcaaggtgcagcgccccacccccaaggggaccgtgatggacatcatcagccggaaggaccagcgcggctccggccaggtcgggacgtacggcctgaacaccttcaccaacatggaggcccagctgatccggcagatggagggggaggacgtgctcagcaagaccgacctggagaacccgcacctgctcgagaagaagatcacccagtggctggagacgaagggcgtggagcgcctgaagcggatggccatctccggggacgactgcgtcgtgaagcccatcgacgaccgcttcgccaacgcgctcctggccctgaacgacatgggcaaggtgcggaaggacatcccccagtggcagcccagcaagggctggcacgactggcagcaggtcccgttctgctcccaccacttccacgagctcatcatgaaggacgggcgcaagctggtggtgccctgccggccccaggacgagctgatcggccgcgcccggatcagccagggggccggctggtccctcaaggagaccgcctgcctggggaaggcgtacgcccagatgtgggccctgatgtacttccaccgccgcgacctccggctggccagcaacgcgatctgctccgccgtccccgtgcactgggtgccgaccagccgcaccacgtggtccatccacgcccaccaccagtggatgaccaccgaggacatgctgaccgtctggaaccgggtgtggatcgaggacaacccctggatggaggacaagacgcccgtgaccacctgggaggacgtcccctacctcggcaagcgcgaggaccagtggtgcggcagcctgatcgggctgaccagccgggccacgtgggcccagaacatcctcaccgcgatccagcaggtgcgctccctgatcggcaacgaggagttcctggactacatgccgagcatgaagcggttccgcaaggaggaggagtccgagggggccatctggtga

SEQ ID NO: 10386 - RNA, 9873 nt, synthetic construct
  misc_feature 1..9873: note = derived and/or modified CDS sequence (opt1) from DENV-3__AY858041__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcgcgcagacctggatgagcgccgagggcgcctggcggcaggtggagaaggtcgagacgtgggccttccgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgctccccccgcaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgggcagggccaggcccacaacggccggctgatcaccgccaaccccgtggtgaccaagaaggaggagcccgtcaacatcgaggcggagtcccccttcggggagagcaacatcatcatcggcatcggggacaaggccctgaagatcaactggtacaagaagggctccagcatcgggaagatgttcgaggccacggcccgcggcgcccggcgcatggcgatcctcggcgacaccgcctgggacttcgggtccgtgggcggggtgctgaacagcctgggcaagatggtccaccagatcttcgggtccgcctacaccgccctcttcagcggcgtgtcctggatcatgaagatcggcatcggggtgctgctgacctggatcggcctcaacagcaagaacacgtccatgagcttctcctgcatcgtcatcgggatcatcaccctgtacctgggcgccgtggtgcaggcggacatggggtgcgtcatcaactggaagggcaaggagctcaagtgcggcagcgggatcttcgtgaccaacgaggtgcacacctggacggagcagtacaagttccaggccgactccccgaagcggctggccaccgccatcgccggcgcgtgggagaacggggtctgcggcatccgcagcaccacccgcatggagaacctgctctggaagcagatcgccaacgagctgaactacatcctgtgggagaacaacatcaagctcacggtggtggtcggggacatcatcggcgtgctggagcagggcaagcggaccctgaccccccagcccatggagctcaagtactcctggaagacctgggggaaggccaagatcgtgacggccgagatccagaacagctccttcatcatcgacggccccaacaccccggagtgccccaacgcgagccgcgcctggaacgtctgggaggtggaggactacgggttcggcgtgttcaccaccaacatctggctgaagctgcgggagatgtacacgcagctctgcgaccaccgcctgatgagcgccgccgtcaaggacgagcgggccgtgcacgcggacatgggctactggatcgagtcccagaagaacgggagctggaagctggagaaggcctccctcatcgaggtgaagacctgcacctggcccaagagccacaccctgtggtccaacggcgtcctggagagcgacatgatcatccccaagtccctcgccgggccgatcagccagcacaactaccgccccggctaccacacccagacggccgggccctggcacctgggcaagctggagctcgacttcaactactgcgagggcaccaccgtggtgatcaccgagaactgcgggacgcggggcccgtccctgcgcaccaccaccgtcagcgggaagctgatccacgagtggtgctgccggtcctgcacgctcccccccctgcgctacatgggcgacgacgggtgctggtacggcatggagatccggcccatcaacgagaaggaggagaacatggtgaagagcctggtgtccgccggcagcgggaaggtcgacaacttcaccatgggcgtgctctgcctggcgatcctgttcgaggaggtgatgcgcgggaagttcggcaagaagcacatgatcgccggggtcctcttcatgttcgtgctgctgctctccggccagatcacctggcgggacatggcccgcaccctgatcatgatcggcagcaacgcctccgaccggatggggatgggcgtgacgtacctggccctcatcgcgaccttcaagatccagccgttcctggccctggggttcttcctccgcaagctgaccagccgggagaacctgctcctgggcgtcggcctggccatggccaccacgctccagctgcccgaggacatcgagcagatggcgaacgggatcgccctgggcctcatggccctgaagctgatcacccagttcgagacctaccagctctggaccgccctggtgagcctgacgtgctccaacaccatcttcaccctcaccgtggcctggcgcacggcgaccctgatcctggccgggatcagcctcctgcccgtctgccagtccagctccatgcggaagaccgactggctgcccatgaccgtggccgccatgggcgtcccgcccctccccctgttcatcttcagcctgaaggacacgctcaagcgccgctcctggcccctgaacgagggggtgatggccgtgggcctggtcagcatcctcgcgtccagcctgctgcggaacgacgtgccgatggccggccccctcgtggccgggggcctgctgatcgcctgctacgtcatcaccgggacctccgccgacctcaccgtggagaaggcggccgacgtgacgtgggaggaggaggccgagcagaccggcgtcagccacaacctgatgatcaccgtggacgacgacgggaccatgcgcatcaaggacgacgagacggagaacatcctgaccgtgctcctgaagaccgccctgctcatcgtctccggcatcttcccctacagcatccccgccaccctgctggtgtggcacacctggcagaagcagacgcagcggtccggcgtgctctgggacgtcccgagcccccccgagacccagaaggcggagctggaggagggggtgtaccgcatcaagcagcagggcatcttcgggaagacccaggtgggcgtcggggtgcagaaggagggcgtgttccacaccatgtggcacgtcacgcggggcgccgtgctgacctacaacgggaagcgcctcgagcccaactgggcctccgtgaagaaggacctgatcagctacggcgggggctggcggctgtccgcccagtggaagaagggggaggaggtccaggtgatcgcggtggagccgggcaagaaccccaagaacttccagaccatgcccggcatcttccagaccacgaccggggagatcggcgccatcgccctggacttcaagcccgggaccagcggcagcccgatcatcaaccgcgagggcaaggtcgtggggctctacggcaacggggtggtcaccaagaacggcgggtacgtgtccggcatcgcccagacgaacgccgagcccgacggccccaccccggagctggaggaggagatgttcaagaagcggaacctgaccatcatggacctccaccccgggagcggcaagacccgcaagtacctgcccgcgatcgtgcgggaggccatcaagcgccggctgcgcacgctcatcctggcccccacccgggtcgtggccgccgagatggaggaggcgctgaaggggctcccgatccgctaccagaccaccgccacgaagtccgagcacaccggcaaggagatcgtggacctgatgtgccacgccaccttcaccatgcggctgctcagccccgtccgcgtgcccaactacaacctgatcatcatggacgaggcccacttcacggaccccgcctccatcgcggcccgggggtacatcagcacccgcgtgggcatgggcgaggccgccgcgatcttcatgaccgccaccccgcccgggacggccgacgccttcccccagtccaacgcccccatccaggacgaggagcgggacatcccggagcgcagctggaactccggcaacgactggatcaccgacttcgcggggaagaccgtctggttcgtgcccagcatcaaggccggcaacgacatcgccaactgcctgcgcaagaacgggaagaaggtgatccagctctcccggaagaccttcgacacggagtaccagaagaccaagctgaacgactgggacttcgtcgtgaccaccgacatcagcgagatgggcgccaacttcaaggccgaccgcgtgatcgacccccggcgctgcctgaagcccgtcatcctcacggacggcccggagcgggtgatcctggcggggcccatgcccgtgaccgtcgcctccgccgcccagcgccggggccgcgtggggcggaacccccagaaggagaacgaccagtacatcttcaccggccagccgctgaacaacgacgaggaccacgcccactggaccgaggcgaagatgctcctggacaacatcaacacgcccgaggggatcatccccgccctgttcgagcccgagcgcgagaagagcgccgccatcgacggcgagtaccggctcaagggcgagtcccgcaagaccttcgtggagctgatgcggcgcggggacctgccggtctggctcgcgcacaaggtggccagcgagggcatcaagtacaccgaccggaagtggtgcttcgacggggagcgcaacaaccagatcctggaggagaacatggacgtcgagatctggaccaaggagggcgagaagaagaagctgcggccccgctggctcgacgcccggacctactccgaccccctggccctgaaggagttcaaggacttcgccgcgggccgcaagagcatcgccctcgacctggtgacggagatcgggcgcgtgccctcccacctggcccaccggacccgcaacgccctcgacaacctggtcatgctgcacaccagcgagcacggcgggcgggcctaccgccacgcggtggaggagctcccggagaccatggagacgctgctgctcctgggcctgatgatcctcctgaccgggggcgccatgctgttcctcatcagcggcaagggggtgggcaagacctccatcgggctgatctgcgtcgtggccagctccggcatgctgtggatggccgacatccccctccagtggatcgccagcgcgatcgtgctggagttcttcatgatggtcctgctcatccccgagccggagaagcagcggaccccccaggacaaccagctggcctacgtggtgatcgggatcctgacgctcgccgccatcgtcgccgcgaacgagatgggcctgctggagaccaccaagcgcgacctcggcatgtccaaggagcccggggtggtgagctccaccagctacctggacgtcgacctgcaccccgcctccgcctggacgctctacgccgtggcgaccaccgtgatcaccccgatgctgcggcacacgatcgagaacagcaccgccaacgtctccctggccgccatcgccaaccaggcggtggtgctcatgggcctggacaaggggtggcccatcagcaagatggacctgggcgtccccctcctggccctggggtgctactcccaggtgaaccccctcaccctgaccgccgccgtgctgctcctggtcacgcactacgccatcatcggcccgggcctgcaggcgaaggccacccgcgaggcccagaagcggaccgccgccgggatcatgaagaaccccaccgtggacggcatcatgacgatcgacctcgaccccgtgatctacgacagcaagttcgagaagcagctggggcaggtcatgctgctcgtgctgtgcgcggtgcagctgctcctgatgcgcacctcctgggccttctgcgaggccctgaccctcgccaccggccccatcacgaccctgtgggagggcagcccggggaagttctggaacaccaccatcgcggtctccatggccaacatcttccggggcagctacctggccggggccggcctcgccttctccatcatgaagagcgtggggacgggcaagcgcggcaccgggagccagggcgagaccctgggggagaagtggaagaagaagctgaaccagctctcccggaaggagttcgacctgtacaagaagagcggcatcaccgaggtggaccgcacggaggcgaaggaggggctgaagcggggcgagatcacccaccacgccgtctcccgcggcagcgccaagctccagtggttcgtggagcggaacatggtgatccccgaggggcgcgtcatcgacctgggctgcgggcggggcgggtggtcctactactgcgccggcctgaagaaggtgaccgaggtgcgcggctacaccaaggggggccccgggcacgaggagcccgtcccgatgagcacctacggctggaacatcgtgaagctcatgtccgggaaggacgtgttctacctgccccccgagaagtgcgacacgctgctgtgcgacatcggcgagagctcccccagcccgaccgtcgaggagtcccggaccatccgcgtgctcaagatggtggagccctggctgaagaacaaccagttctgcatcaaggtcctgaacccctacatgcccaccgtgatcgagcacctcgagcgcctgcagcggaagcacggcgggatgctggtgcgcaacccgctcagccggaactccacgcacgagatgtactggatcagcaacggcaccgggaacatcgtctccagcgtgaacatggtgtcccgcctgctgctcaaccggttcaccatgacctaccgccggcccacgatcgagaaggacgtcgacctgggcgccggcacccgccacgtgaacgcggagcccgagacccccaacatggacgtcatcggggagcggatccgccggatcaaggaggagcacagctccacctggcactacgacgacgagaacccgtacaagacgtgggcctaccacggcagctacgaggtgaaggccaccgggagcgcctccagcatgatcaacggcgtggtcaagctgctcaccaagccctgggacgtggtgcccaccgtcacgcagatggccatgaccgacaccaccccgttcgggcagcagcgcgtgttcaaggagaaggtggacacgcggacccccaagcccatgcccggcacccgcaaggtcatggagatcaccgcggagtggctgtggcggacgctgggccgcaacaagcggccgcgcctctgcacccgggaggagttcaccaagaaggtgcgcaccaacgccgccatgggggccgtgttcacggaggagaaccagtgggactccgcgcgcgccgccgtcgaggacgaggagttctggaagctggtggaccgggagcgcgagctgcacaagcagggcaagtgcgggagctgcgtgtacaacatgatgggcaagcgggagaagaagctcggggagttcggcaaggccaagggctcccgcgccatctggtacatgtggctgggggcgcggtacctggagttcgaggccctcggcttcctgaacgaggaccactggttcagccgcgagaactcctacagcggggtcgagggcgaggggctgcacaagctcggctacatcctgcgggacatctccaagatccccggcggggccatgtacgccgacgacaccgccggctgggacacccgcatcaccgaggacgacctgcacaacgaggagaagatcacgcagcagatggaccccgagcaccggcagctcgcgaacgccatcttcaagctgacctaccagaacaaggtggtgaaggtccagcgccccaccccgaaggggaccgtgatggacatcatcagccggaaggaccagcgcggctccggccaggtggggacgtacggcctgaacaccttcaccaacatggaggcccagctcatccggcagatggagggggagggcgtcctgagcaagaccgacctggagaacccccacctcctggagaagaagatcacccagtggctggagacgaagggggtggagcgcctcaagcggatggccatctccggcgacgactgcgtggtcaagcccatcgacgaccgcttcgccaacgcgctgctggccctcaacgacatgggcaaggtgcggaaggacatcccccagtggcagccgagcaaggggtggcacgactggcagcaggtgcccttctgctcccaccacttccacgagctgatcatgaaggacggccgcaagctggtcgtgccctgccggccccaggacgagctcatcgggcgcgcccggatcagccagggcgccgggtggtccctgaaggagaccgcctgcctgggcaaggcgtacgcccagatgtgggccctcatgtacttccaccgccgcgacctgcggctggccagcaacgcgatctgctccgccgtgccggtccactgggtgcccaccagccgcaccacgtggagcatccacgcccaccaccagtggatgaccaccgaggacatgctcaccgtgtggaaccgggtctggatcgaggacaacccctggatggaggacaagacgcccgtgaccacctgggaggacgtgccgtacctgggcaagcgcgaggaccagtggtgcgggtccctgatcggcctcaccagccgggccacgtgggcccagaacatcctgaccgcgatccagcaggtccgctccctgatcgggaacgaggagttcctcgactacatgcccagcatgaagcggttccgcaaggaggaggagtccgagggcgccatctggtga

SEQ ID NO: 10387 - RNA, 9873 nt, synthetic construct
  misc_feature 1..9873: note = derived and/or modified CDS sequence (opt1) from DENV-3__KC261634__SS-prME
  source 1..9873: mol_type = other RNA
accagcatctgcctgatgatgatgctccccgccaccctggccttccacctgacgagccgggacggcgagccgcggatgatcgtggggaagaacgagcggggcaagagcctcctgttcaagaccgcgagcgggatcaacatgtgcaccctgatcgccatggacctcggcgagatgtgcgacgacaccgtgacctacaagtgccccctgatcgccgaggtggagcccgaggacatcgactgctggtgcaacctgaccagcacctgggtgacctacgggacgtgcaaccaggccggcgagcaccggcgcgacaagcggagcgtcgccctcgcgccccacgtgggcatggggctggacacccgcacccagacctggatgagcgccgagggcgcctggcggcaggtcgagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaaccggcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgacacccagggggtcaccgtggagatcacgccccaggccagcaccgtggaggccgtcctgcccgagtacggcaccctggggctcgagtgctccccgcggaccggcctggacttcaacgagatgatcctgctcaccatgaagaacaaggcgtggatggtgcaccgccagtggttcttcgacctgcccctgccctggacgagcggcgccaccaccgagacccccacgtggaaccggaaggagctcctggtgaccttcaagaacgcccacgccaagaagcaggaggtcgtggtgctggggtcccaggagggcgccatgcacaccgcgctcaccggggccacggagatccagaacagcggcgggacctccatcttcgccggccacctgaagtgccgcctgaagatggacaagctcgagctgaagggcatgagctacgccatgtgcctgaacaccttcgtcctcaagaaggaggtgtccgagacccagcacgggacgatcctgatccgggtggagtacaagggcgaggacgccccgtgcaagatccccttcagcaccgaggacgggcagggcaaggcgcacaacggccgcctgatcaccgccaaccccgtcgtgaccaagaaggaggagcccgtgaacatcgaggccgagccgcccttcggggagagcaacatcgtcatcggcacgggggacaaggccctgaagatcaactggtacaagaagggctccagcatcgggaagatgttcgaggcgaccgcccggggcgcccgccgcatggccatcctcggcgacaccgcctgggacttcgggtccgtgggcggggtgctgaacagcctgggcaagatggcgcaccagatcttcgggtccgcctacaccgccctcttcagcggcgtctcctggatcatgaagatcggcatcggggtgctgctgacgtggatcggcctcaacagcaagaacacctccatgagcttctcctgcatcgtgatcgggatcatcaccctgtacctgggcgccgtcgtgcaggccgacatggggtgcgtgatcaactggaagggcaaggagctcaagtgcggcagcgggatcttcgtcaccaacgaggtgcacacgtggaccgagcagtacaagttccaggcggactcccccaagcggctggccaccgccatcgccggcgcctgggagaacggggtgtgcggcatccgcagcaccacgcggatggagaacctgctctggaagcagatcgcgaacgagctgaactacatcctgtgggagaacaacatcaagctcaccgtcgtggtgggggacatcatcggcgtcctggagcagggcaagcgcaccctgacgccccagccgatggagctcaagtactcctggaagacgtgggggaaggccaagatcgtgaccgccgagatccagaacagctccttcatcatcgacggccccaacacccccgagtgccccagcgcctcccgggcgtggaacgtgtgggaggtcgaggactacgggttcggcgtgttcaccacgaacatctggctgaagctgcgcgaggtgtacacccagagctgcgaccaccggctcatgagcgccgccatcaaggacgagcgcgccgtccacgccgacatgggctactggatcgagtcccagaagaacgggagctggaagctggagaaggcgtccttcatcgaggtgaagacctgcacctggcccaagagccacaccctgtggtccaacggcgtgctcgagagcgacatgatcatcccgaagtccctggccgggcccatcagccagcacaaccaccggccgggctaccacacgcagaccgccgggccctggcacctgggcaagctcgagctggacttcaactactgcgagggcaccaccgtcgtgatcacggagaactgcgggacccgcggcccctccctgcggaccaccacggtgagcgggaagctcatccacgagtggtgctgccgctcctgcaccctgcccccgctgcggtacatgggcgaggacgggtgctggtacggcatggagatccgccccatcaacgagaaggaggagaacatggtcaagagcctcgtgtccgccggcagcgggaaggtggacaacttcaccatgggcgtcctgtgcctggccatcctcttcgaggaggtgatgcgggggaagttcggcaagaagcacatgatcgtgggggtcctgttcaccttcgtgctgctcctgtccggccagatcacgtggcgcgacatgacccacaccctgatcatgatcggcagcaacgcgtccgaccggatggggatgggcgtgacctacctcgccctgatcgccacgttcaagatccagcccttcctggccctcgggttcttcctgcgcaagctgaccagccgggagaacctcctgctgggcgtcggcctcgccatggcgaccaccctgcagctgcccgaggacatcgagcagatggccaacgggatcgccctcggcctgatgacgctgaagctcatcacccagttcgagacctaccagctgtggaccgccctggtgagcctcacgtgctccaacaccatcttcaccctgaccgtcgcgtggcgcacggccaccctgatcctcgccggggtgagcctgctgccgctctgccagtccagctccatgcgcaagaccgactggctgcccatgaccgtggccgccatgggcgtgccgcccctccccctcttcatcttcagcctgaaggacgcgcccaagaagcggtcctggcccctgaacgagggggtgatggccgtgggcctcgtcagcatcctggcctccagcctgctccgcaacgacgtgcccatggccggcccgctggtggccgggggcctgctcatcgcgtgctacgtcatcacggggacctccgccgacctgaccgtggagaaggccgccgacgtgacctgggaggaggaggccgagcagacgggcgtcagccacaacctgatgatcaccgtggacgacgacgggaccatgcggatcaaggacgacgagaccgagaacatcctcaccgtgctgctgaagacggcgctcctgatcgtctccggcatcttcccctacagcatccccgccaccctgctcgtgtggcacacctggcagaagcagacccagcgctccggcgtgctgtgggacgtccccagcccgcccgagacgcagaaggccgagctggaggagggggtgtaccggatcaagcagcagggcatcttcgggaagacccaggtgggcgtcggggtgcagaaggagggcgtgttccacaccatgtggcacgtcacccgcggcgccgtgctcacgcacaacgggaagcggctggagcccaactgggcctccgtgaagaaggacctgatcagctacggcgggggctggcgcctctccgcgcagtggcagaagggggaggaggtccaggtgatcgccgtggagcccggcaagaacccgaagaacttccagaccatgcccggcatcttccagaccaccacgggggagatcggcgccatcgccctggacttcaagcccgggaccagcggcagcccgatcatcaaccgggagggcaaggtcgtggggctgtacggcaacggggtggtcaccaagaacggcgggtacgtgtccggcatcgcgcagaccaacgccgagcccgacggccccacgcccgagctggaggaggagatgttcaagaagcgcaacctcaccatcatggacctgcacccggggagcggcaagacccggaagtacctgcccgccatcgtgcgcgaggccatcaagcggcgcctccggaccctgatcctggcccccacgcgcgtcgtggcggccgagatggaggaggccctcaaggggctgcccatccggtaccagaccaccgccaccaagtccgagcacacgggccgcgagatcgtggacctgatgtgccacgccaccttcaccatgcggctcctgagcccggtccgcgtgcccaactacaacctgatcatcatggacgaggcgcacttcaccgaccccgcctccatcgccgcccgggggtacatcagcacgcgcgtgggcatgggcgaggccgcggccatcttcatgaccgccacgcccccggggaccgccgaggcgttcccccagtccaacgcccccatccaggacgaggagcgcgacatccccgagcggagctggaactccggcaacgagtggatcacggacttcgtcgggaagaccgtgtggttcgtgccgagcatcaaggccggcaacgacatcgccaactgcctccgcaagaacgggaagaaggtcatccagctgtcccggaagaccttcgacaccgagtaccagaagacgcgcctgaacgactgggacttcgtggtgaccaccgacatcagcgagatgggcgccaacttcaaggcggaccgggtcatcgacccccgccggtgcctcaagcccgtgatcctgaccgacggccccgagcgcgtgatcctggccgggccgatgcccgtcacggccgcctccgccgcgcagcggcgcggccgggtggggcgcaacccccagaaggagaacgaccagtacatcttcaccggccagcccctcaacaacgacgaggaccacgcccactggaccgaggccaagatgctgctggacaacatcaacaccccggaggggatcatccccgccctcttcgagcccgagcgggagaagtccgccgcgatcgacggcgagtaccgcctgaagggcgagtcccggaagaccttcgtcgagctgatgcgccgcggggacctccccgtgtggctggcccacaaggtggccagcgagggcatcaagtacacggaccgcaagtggtgcttcgacggggagcggaacaaccagatcctggaggagaacatggacgtcgagatctggaccaaggagggcgagcgcaagaagctccgcccgcggtggctggacgcccgcacctactccgaccccctggcgctcaaggagttcaaggacttcgccgccggccgcaagagcatcgccctggacctggtgaccgagatcgggcgcgtgccctcccacctcgcccaccggacgcgcaacgcgctggacaacctggtcatgctccacaccagcgagcacggcgggcgggcctaccgccacgccgtggaggagctgccggagaccatggagaccctgctcctgctgggcctcatgatcctgctgaccggcggggccatgctgttcctgatcagcgggaaggggatcggcaagacctccatcgggctgatctgcgtgatcgtcagctccggcatgctctggatggccgacgtgcccctgcagtggatcgcgagcgccatcgtgctggagttcttcatgatggtcctcctgatccccgagcccgagaagcagcggaccccgcaggacaaccagctggcctacgtggtgatcgggatcctcaccctggccgccatcgtcgcggccaacgagatgggcctgctcgagacgaccaagcgcgacctgggcatgtccaaggagcccggggccgtgagctccaccagctacctggacgtggacctccaccccgcctccgcctggaccctgtacgcggtcgccacgaccgtgatcacccccatgctgcggcacaccatcgagaacagcacggccaacgtgtccctcgccgcgatcgccaaccaggccgtcgtgctgatgggcctggacaaggggtggccgatcagcaagatggacctcggcgtgcccctgctggccctcgggtgctactcccaggtcaaccccctgaccctgaccgccgcggtgctcctgctggtgacccactacgccatcatcggccccggcctccaggccaaggccacgcgcgaggcccagaagcggaccgcggccgggatcatgaagaacccgaccgtcgacggcatcatgaccatcgacctggaccccgtgatctacgacagcaagttcgagaagcagctgggccaggtgatgctcctggtcctgtgcgccgtgcagctcctgctgatgcgcacgtcctgggccctctgcgaggccctgaccctggcgaccggccccatcaccacgctctgggagggcagccccgggaagttctggaacaccaccatcgccgtgtccatggccaacatcttccggggcagctacctggccggggcgggcctggccttctccatcatgaagtccgtcgggaccggccgccggggcacggggagccagggcgagaccctcggggagaagtggaagaagcgcctgaaccagctgtcccggaaggagttcgacctctacaagaagtccggcatcaccgaggtggaccgcaccgaggccaaggaggggctgaagcggggcgagaccacgcaccacgccgtgtcccgcggcagcgccaagctgcagtggttcgtcgagcgcaacatggtgatcccggaggggcgggtgatcgacctcggctgcgggcgcggcgggtggtcctactactgcgcgggcctgaagaaggtcaccgaggtgcggggctacaccaagggcgggcccgggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgggtcctgaagatggtggagccgtggctcaagaacaaccagttctgcatcaaggtgctgaacccctacatgcccaccgtcatcgagcacctggagcgcctccagcggaagtacggcgggatgctggtgcgcaaccccctgagccggaactccacgcacgagatgtactggatcagcaacggcaccgggaacatcgtgtccagcgtcaacatggtgtcccgcctcctgctgaaccggttcaccatgacccaccgccggccgacgatggagaaggacgtcgacctcggcgccggcacccgccacgtgaacgccgagcccgagacccccaacatggacgtgatcggggagcggatcaagcgcatcaaggaggagcacagctccacctggcactacgacgacgagaacccgtacaagacgtgggcctaccacggcagctacgaggtcaaggccaccgggagcgcgtccagcatgatcaacggcgtggtgaagctgctgaccaagccctgggacgtcgtgcccatggtgacccagatggccatgacggacaccacccccttcgggcagcagcgggtcttcaaggagaaggtggacacccgcacgccgcggcccatgcccggcacccgcaaggtgatggagatcaccgccgagtggctctggcgcaccctgggccggaacaagaagccccgcctgtgcacgcgggaggagttcaccaagaaggtccgcaccaacgccgccatgggggcggtgttcaccgaggagaaccagtgggactccgcccgggccgccgtggaggacgaggagttctggaagctcgtcgaccgcgagcgggagctgcaccgcctgggcaagtgcgggagctgcgtgtacaacatgatgggcaagcgggagaagaagctcggggagttcggcaaggcgaagggctcccgcgccatctggtacatgtggctgggggcccggtacctggagttcgaggccctcggcttcctgaacgaggaccactggttcagccgcgagaactcctacagcggggtggagggcgaggggctgcacaagctcggctacatcctgcgggacatctccaagatcccgggcggggccatgtacgcggacgacacggccggctgggacacccgcatcaccgaggacgacctgcacaacgaggagaagatcacccagcagatggaccccgagcaccggcgcctcgccagcgccatcttcaagctgacgtaccagaacaaggtcgtgaaggtgcagcggcccacccccaaggggaccgtcatggacatcatctcccgcaaggaccagcggggcagcggccaggtggggacctacggcctgaacaccttcacgaacatggaggcccagctcgtgcgccagatggagggggagggcgtcctgtccaaggcggacctggaggacccgcacctcctggagaagaagatcacccagtggctggagaccaagggggtggagcggctcaagcgcatggccatcagcggcgacgactgcgtggtcaagcccatcgacgaccgcttcgccaacgccctgctggccctcaacgacatgggcaaggtgcggaaggacatcccccagtggcagccctccaaggggtggcacgactggcagcaggtcccgttctgcagccaccacttccacgagctgatcatgaaggacggccgcaagctggtcgtgccctgccggccccaggacgagctcatcgggcgcgcgcggatctcccagggcgccgggtggagcctgaaggagaccgcctgcctgggcaaggcctacgcccagatgtggtccctcatgtacttccaccgccgggacctgcgcctggcgagcaacgccatctgcagcgccgtgcccgtccactgggtgccgacgtcccggaccacctggagcatccacgcccaccaccagtggatgaccacggaggacatgctcaccgtgtggaaccgcgtctggatcgaggacaacccctggatggaggacaagacccccgtgaccacgtgggaggacgtgccctacctgggcaagcgggaggaccagtggtgcgggtccctgatcggcctcaccagccgcgcgacctgggcccagaacatcctgaccgccatccagcaggtccggtccctgatcggggacgaggagttcctcgactacatgccgagcatgaagcgcttccggaaggaggaggagtccgagggcgccatctggtga

SEQ ID NO: 10388 - RNA, 9873 nt, synthetic construct
  misc_feature 1..9873: note = derived and/or modified CDS sequence (opt1) from DENV-3__JN662391__SS-prME
  source 1..9873: mol_type = other RNA
accagcctgtgcctcatgatgatcctgcccgccgccctggcgttccacctcaccagccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtggccctcgcgccccacgtgggcatggggctggacacccgcacccagacctggatgagcgccgagggcgcctggcggcaggtcgagaaggtggagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggagtacaagggcgaggacgcgccgtgcaagatccccttcagcaccgaggacgagcaggggaaggcccacaacggccgcctgatcacggccaaccccgtcgtgaccaagaaggaggagcccgtgaacatcgaggccgagccgcccttcggcgagagcaacatcgtcatcgggatcggcgacaacgcgctgaagatcaactggtacaagaaggggtccagcatcggcaagatgttcgaggccaccgcccgcggggcccgccggatggccatcctgggcgacaccgcgtgggacttcggctccgtcgggggcgtgctcaacagcctggggaagatggtccaccagatcttcggctccgcctacacggccctgttcagcggggtgtcctgggtgatgaagatcggcatcggcgtcctcctgacctggatcgggctgaacagcaagaacacctccatgagcttctcctgcatcgccatcggcatcatcaccctctacctgggggccgtggtgcaggcggacatgggctgcgtcatcaactggaaggggaaggagctgaagtgcggcagcggcatcttcgtgacgaacgaggtgcacacctggaccgagcagtacaagttccaggccgactcccccaagcgcctcgccaccgccatcgccggggcgtgggagaacggcgtctgcgggatccgcagcacgacccggatggagaacctgctgtggaagcagatcgccaacgagctcaactacatcctgtgggagaacaacatcaagctgaccgtggtggtcggcgacaccatcggggtgctcgagcagggcaagcgcacgctgacgccccagccgatggagctgaagtactcctggaagacctggggcaaggccaagatcgtgaccgccgagacgcagaacagctccttcatcatcgacgggcccaacacccccgagtgccccagcgcgtcccgggcctggaacgtctgggaggtggaggactacggcttcggggtgttcaccaccaacatctggctcaagctgcgcgaggtctacacccagatgtgcgaccaccggctgatgagcgccgccgtgaaggacgagcgcgccgtgcacgcggacatgggctactggatcgagagccagaagaacggctcctggaagctcgagaaggccagcctgatcgaggtcaagacgtgcacctggccgaagtcccacaccctgtggagcaacggggtgctcgagtccgacatgatcatccccaagagcctggccggccccatctcccagcacaactaccggccggggtaccacacccagacggccggcccctggcacctggggaagctcgagctggacttcaactactgcgagggcaccaccgtggtcatcaccgagaactgcggcacgcgcgggcccagcctgcggaccaccaccgtgtccggcaagctcatccacgagtggtgctgccgcagctgcacgctgcccccgctgcggtacatgggggaggacggctgctggtacgggatggagatccgccccatctccgagaaggaggagaacatggtcaagagcctcgtctccgccggcagcggcaaggtggacaacttcaccatgggggtgctgtgcctggcgatcctcttcgaggaggtcatgcggggcaagttcgggaagaagcacatgatcgccggcgtgttcctgaccttcatgctgctcctgtccgggcagatcacctggcgcgacatggcccacacgctgatcatgatcggcagcaacgcctccgaccggatgggcatgggggtgacctacctcgccctgatcgcgaccttcaagatccagcccttcctggccctcggcttcttcctgcgcaagctgaccagccgggagaacctcctgctgggggtcggcctcgccatggccacgaccatccagctgcccgaggacatcgagcagatggcgaacggcatcgccctggggctcatggccctgaagctgatcacccagttcgagacctaccagctctggacggccctgatcagcctgacctgctccaacaccatcttcaccctcacggtggcctggcgcaccgcgaccctgatcctggccggcgtgagcctcctgccggtctgccagtccagctccatgcggaagaccgactggctgcccatgacggtggccgccatgggggtgccgcccctcccgctgttcatcttcagcctgaaggacaccctcaagcgccgctcctggcccctgaacgagggcgtgatggccgtggggctggtcagcatcctcgcgtccagcctgctgcggaacgacgtgcccatggccggccccctcgtggccggcgggctgctgatcgcctgctacgtcatcaccggcacctccgccgacctcacggtggagaaggcggccgacgtgacctgggaggaggaggccgagcagaccggggtcagccacaacctgatgatcaccgtggacgacgacggcaccatgcgcatcaaggacgacgagacggagaacatcctgaccgtgctcctgaagaccgccctgctcatcgtctccgggatcttcccgtacagcatccccgccaccctgctggtgtggcacacgtggcagaagcagacccagcggtccggcgtgctctgggacgtccccagcccgcccgagacccagaaggcggagctggaggagggcgtgtaccgcatcaagcagcaggggatcctgggcaagacccaggtgggggtcggcgtgcagaaggagggggtgttccacacgatgtggcacgtcacccggggcgccgtgctcacccacaacggcaagcgcctggagcccaactgggcctccgtgaagaaggacctgatcagctacgggggcgggtggcggctctccgcccagtggcagaagggcgaggaggtccaggtgatcgcggtggagcccgggaagaaccccaagaacttccagaccatgcccggcacgttccagaccaccaccggcgagatcggggccatcgccctggacttcaagcccggcacgagcgggagccccatcatcaaccgcgagggcaaggtcgtgggcctgtacgggaacggcgtggtcaccaagaacgggggctacgtgtccgggatcgcccagaccaacgccgagccggacggccccacccccgagctggaggaggagatgttcaagaagcggaacctcacgatcatggacctgcaccccggcagcgggaagacccgcaagtacctgccggcgatcgtgcgggaggccatcaagcgccggctccgcaccctgatcctggcccccacccgggtcgtggccgccgagatggaggaggcgctcaagggcctgcccatccgctaccagacgaccgccaccaagtccgagcacaccgggcgggagatcgtggacctgatgtgccacgccacgttcaccatgcgcctcctgagccccgtccgggtgccgaactacaacctgatcatcatggacgaggcccacttcaccgaccccgcctccatcgcggcccgcggctacatcagcacccgggtggggatgggcgaggccgccgcgatcttcatgacggccacgccgcccggcaccgccgacgccttcccgcagtccaacgcccccatccaggacgaggagcgcgacatccccgagcgcagctggaactccgggaacgagtggatcaccgacttcgcgggcaagacggtctggttcgtgcccagcatcaaggccgggaacgacatcgccaactgcctccggaagaacggcaagaaggtgatccagctgtcccgcaagaccttcgacaccgagtaccagaagaccaagctgaacgactgggacttcgtcgtgacgaccgacatcagcgagatgggggccaacttcaaggccgaccgggtgatcgacccgcgccggtgcctcaagcccgtcatcctgaccgacggccccgagcgcgtgatcctggcgggccccatgccggtgaccgtcgcctccgccgcccagcggcgcgggcgggtgggccgcaacccccagaaggagaacgaccagtacatcttcaccgggcagcccctcaacaacgacgaggaccacgcccactggacggaggcgaagatgctgctggacaacatcaacacccccgagggcatcatcccggccctcttcgagcccgagcgggagaagtccgccgccatcgacggggagtaccgcctgaagggcgagtcccggaagaccttcgtggagctgatgcgccggggcgacctccccgtctggctggcgcacaaggtggccagcgaggggatcaagtacaccgaccgcaagtggtgcttcgacggccagcggaacaaccagatcctggaggagaacatggacgtcgagatctggacgaaggagggggagaagaagaagctccgcccccggtggctggacgcccgcacctactccgacccgctggccctcaaggagttcaaggacttcgccgcgggccgcaagagcatcgccctggacctggtgaccgagatcggccgggtgccctcccacctcgcccaccgcacccggaacgccctggacaacctggtcatgctccacacgagcgagcacgggggccgcgcctaccggcacgcggtggaggagctgcccgagaccatggagaccctgctcctgctggggctcatgatcctgctgaccggcggggccatgctgttcctgatcagcggcaagggcatcgggaagacgtccatcggcctgatctgcgtgatcgccagctccgggatgctctggatggccgagatcccgctgcagtggatcgccagcgcgatcgtcctggagttcttcatgatggtgctcctgatccccgagcccgagaagcagcgcacgccccaggacaaccagctggcctacgtggtcatcggcatcctcaccctggccgccatcatcgccgcgaacgagatggggctgctcgagaccacgaagcgggacctgggcatgtccaaggagccgggcgtggtgagccccacctcctacctggacgtcgacctccaccccgccagcgcctggaccctgtacgccgtggcgaccacggtgatcacccccatgctgcgccacaccatcgagaactccaccgccaacgtcagcctcgccgccatcgccaaccaggcggtggtgctgatggggctggacaagggctggccgatctccaagatggacctcggggtccccctgctggccctcggctgctacagccaggtgaaccccctgacgctgaccgccgccgtgctcctgctggtcacccactacgccatcatcgggcccggcctccaggcgaaggccacccgggaggcccagaagcgcacggccgccggcatcatgaagaacccgaccgtggacgggatcatcaccatcgacctggaccccgtgatctacgactccaagttcgagaagcagctgggccaggtcatgctcctggtgctgtgcgcggtgcagctcctgctgatgcggaccagctgggccctctgcgaggccctgacgctggccaccgggcccatcaccaccctctgggagggctcccccggcaagttctggaacacgaccatcgcggtcagcatggccaacatcttccgcgggtcctacctggccggcgccgggctggccttcagcatcatgaagtccgtgggcaccgggaagcggggcaccggcagccagggggagaccctcggcgagaagtggaagaagaagctgaaccagctgagccgcaaggagttcgacctctacaagaagtccgggatcacggaggtggaccggaccgaggcgaaggagggcctgaagcgcggggagaccacccaccacgccgtcagccggggctccgccaagctgcagtggttcgtggagcgcaacatggtgatcccggagggccgggtcatcgacctcgggtgcggccgcgggggctggagctactactgcgccgggctgaagaaggtgacggaggtgcggggctacaccaagggcgggcccggccacgaggagcccgtccccatgtccacccacgggtggaacatcgtgaagctgatgagcggcaaggacgtgttctacctcccgcccgagaagtgcgacaccctgctgtgcgacatcggggagtccagcccctcccccacggtcgaggagagccgcaccatccgcgtgctgaagatggtggagccgtggctcaagaacaaccagttctgcatcaaggtcctgaacccctacatgcccgccgtgatcgagcacctggagcggctccagcgcaagcacggcggcatgctggtgcggaaccccctgtcccgcaacagcacccacgagatgtactggatctccaacgggaccggcaacatcgtcagctccgtgaacatggtgagccggctcctgctgaaccgcttcacgatgacccaccggcgcccgaccatcgagaaggacgtcgacctcggggcgggcacccggcacgtgaacgccgagcccgagacgcccaacatggacgtgatcggcgagcgcatccggcgcatcaaggaggagcacaactccacctggcactacgacgacgagaacccgtacaagacctgggcctaccacgggagctacgaggtcaaggccaccggctccgccagcagcatgatcaacggggtggtcaagctgctgacgaagccctgggacgtggtgcccatggtcacccagatggcgatgaccgacaccacgcccttcggccagcagcgggtgttcaaggagaaggtggacacccgcaccccgcggcccatgcccgggacccgcaaggtcatggagatcacggccgagtggctctggcggaccctgggccgcaacaagcggccccgcctgtgcacccgcgaggagttcaccaagaaggtgcggacgaacgccgccatgggcgcggtgttcaccgaggagaaccagtgggactccgccaaggccgccgtcgaggacgaggagttctggaagctcgtggaccgcgagcgggagctgcacaagctggggaagtgcggcagctgcgtgtacaacatgatggggaagcgcgagaagaagctcggcgagttcgggaaggccaagggctcccgggcgatctggtacatgtggctgggcgcccgctacctggagttcgaggccctcgggttcctgaacgaggaccactggttcagccgggagaactcctacagcggcgtcgagggggagggcctgcacaagctcgggtacatcctgcgcgacatctccaagatcccgggcggcgccatgtacgccgacgacaccgcggggtgggacacccggatcacggaggacgacctgcacaacgaggagaagatcacccagcagatgaaccccgagcaccgcctcctggccaacgccatcttcaagctgacctaccagaacaaggtggtgaaggtccagcggcccacccccaccggcacggtgatggacatcatcagccgcaaggaccagcgggggtccggccaggtgggcacctacgggctcaacaccttcaccaacatggaggcccagctggtccgccagatggagggcgagggggtgctgagcaaggccgacctcgagaacccgcacctccccgagaagaagatcacgcagtggctggagaccaagggcgtggagcggctcaagcgcatggcgatctccggggacgactgcgtcgtgaagcccatcgacgaccggttcgccaacgccctgctggccctcaacgacatgggcaaggtgcgcaaggacatcccccagtggcagccgagcaagggctggcacgactggcagcaggtccccttctgctcccaccacttccacgagctgatcatgaaggacgggcggaagctggtggtgccctgccgcccccaggacgagctcatcggccgggcccgcatcagccagggggcgggctggtccctgcgcgagaccgcctgcctggggaaggcctacgcccagatgtggagcctcatgtacttccaccggcgcgacctgcggctggcgtccaacgccatctgcagcgccgtcccggtgcactgggtgcccacctcccgcacgacctggagcatccacgcccaccaccagtggatgaccaccgaggacatgctcacggtctggaaccgggtgtggatcgaggacaacccctggatggaggacaagacccccgtgaccacctgggagaacgtcccgtacctgggcaagcgcgaggaccagtggtgcggcagcctgatcgggctcacgtcccgggccacctgggcgcagaacatcagcaccgccatccagcaggtccgctccctgatcggcaacgaggagttcctggactacatgcccagcatgaagcggttccgcaaggaggaggagtccgagggggccatctggtga

SEQ ID NO: 10389 - RNA, 9873 nt, synthetic construct
  misc_feature 1..9873: note = derived and/or modified CDS sequence (opt1) from DENV-3__AY858043__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcgcgcagacctggatgagcgccgagggcgcctggcggcaggccgagaaggtggagacgtgggcgctccgccacccggggttcaccatcctggccctgttcctcgcccactacatcggcacctccctgacccagaaggtcgtgatcttcatcctgctcatgctggtgacgcccagcatgaccatgcggtgcgtcggggtgggcaaccgcgacttcgtggagggcctgtccggggccacctgggtcgacgtggtgctcgagcacggcgggtgcgtcaccacgatggccaagaacaagcccaccctggacatcgagctgcagaagaccgaggcgacccagctcgccacgctgcggaagctgtgcatcgagggcaagatcaccaacgtgaccaccgacagccgctgccccacgcagggcgaggccatcctcccggaggagcaggaccagaactacgtgtgccggcacacctacgtcgaccgcgggtggggcaacgggtgcggcctgttcgggaagggctccctggtgacctgcgccaagttccagtgcctcgagctgatcgagggcaaggtggtccagcacgagaacctgaagtacaccgtgatcatcacggtgcacaccggggaccagcaccaggtcggcaacgagacccagggggtgaccgccgagatcacgccccaggcgagcaccgtcgaggccatcctccccgagtacggcaccctggggctggagtgctccccccggaccggcctcgacttcaacgagatgatcctgctgaccatgaagaacaaggcctggatggtgcaccgccagtggttcttcgacctcccgctgccctggacgagcggcgccaccaccgagacccccacgtggaacaagaaggagctgctcgtgaccttcaagaacgcccacgcgaagaagcaggaggtcgtggtgctggggtcccaggagggcgccatgcacaccgccctgaccggggccacggagatccagaccagcggcgggacctccatcttcgccggccacctcaagtgccggctgaagatggacaagctggagctcaagggcatgagctacgcgatgtgctccaacgccttcgtcctgaagaaggaggtgagcgagacccagcacgggacgatcctgatcaaggtggagtacaagggcgaggacgccccctgcaagatcccgttcagcaccgaggacgggcagggcaaggtccacaacggccgcctgatcaccgccaaccccgtggtgaccaagaaggaggagcccgtcaacatcgaggcggagcccccgttcggggagtccaacatcatcatcggcatcggggacaaggccctcaagatcaactggtacaagaagggcagctccatcgggaagatgttcgaggccacggcccggggcgcccgccggatggcgatcctgggcgacaccgcctgggacttcgggagcgtgggcggggtgctgaactccctcggcaagatggtccaccagatcttcgggagcgcctacaccgccctgttctccggcgtgagctggatcatgaagatcggcatcggggtgctgctcacctggatcggcctgaactccaagaacacgagcatgtccttcagctgcatcgtcatcgggatcatcaccctgtacctcggcgccgtggtgcaggcggacatggggtgcgtcatcaactggaagggcaaggagctgaagtgcggctccgggatcttcgtgaccaacgaggtgcacacctggacggagcagtacaagttccaggccgacagccccaagcgcctggccaccgccatcgccggcgcgtgggagaacggggtctgcggcatccgctccaccacccggatggagaacctcctgtggaagcagatcgccaacgagctgaactacatcctctgggagaacaacatcaagctgacggtggtggtcggggacatcatcggcgtgctggagcagggcaagcgcaccctcaccccccagcccatggagctgaagtacagctggaagacctgggggaaggccaaggtggtcacggccgagatccagaactccagcttcatcatcgacggcccgaacacccccgagtgccccaacgcgtcccgggcctggaacgtgtgggaggtggaggactacgggttcggcgtcttcaccaccaacatctggctgaagctccgcgagatgtacacgcagctgtgcgaccaccggctgatgagcgccgccgtgaaggacgagcgcgccgtgcacgcggacatgggctactggatcgagagccagaagaacgggtcctggaagctcgagaaggccagcctgatcgaggtcaagacctgcacctggcccaagtcccacaccctgtggagcaacggcgtgctcgagtccgacatgatcatcccgaagagcctggccgggcccatctcccagcacaactaccggcccggctaccacacccagacggccgggccgtggcacctgggcaagctcgagctggacttcaactactgcgagggcaccaccgtggtcatcaccgagaactgcgggacgcgcggccccagcctgcggaccaccaccgtgtccgggaagctcatccacgagtggtgctgccgcagctgcacgctgccccccctgcggtacatgggcgaggacgggtgctggtacggcatggagatccgcccgatcaacgagaaggaggagaacatggtgaagtccctcgtcagcgccggctccgggaaggtggacaacttcaccatgggcgtgctgtgcctggcgatcctcttcgaggaggtcatgcgggggaagttcggcaagaagcacatgatcgccggggtgctgttcatgttcgtgctgctcctgagcggccagatcacctggcgcgacatggcccggaccctgatcatgatcggctccaacgccagcgaccgcatggggatgggcgtcacgtacctcgccctgatcgcgaccttcaagatccagcccttcctggccctcgggttcttcctgcggaagctgacctcccgcgagaacctcctgctgggcgtgggcctcgccatggccaccacgctgcagctgcccgaggacatcgagcagatggcgaacgggatcgccctcggcctgatggccctgaagctcatcacccagttcgagacctaccagctgtggaccgccctggtgagcctcacgtgcagcaacaccatcttcaccctgaccgtcgcctggcggacggcgaccctgatcctcgccgggatctccctgctgcccgtgtgccagagctccagcatgcgcaagaccgactggctcccgatgaccgtcgccgccatgggcgtgccccccctgcccctgttcatcttctccctcaaggacacgctgaagcgccggagctggccgctgaacgagggggtgatggccgtcggcctcgtgtccatcctggcgagctccctgctccgcaacgacgtgcccatggccggccccctggtcgccgggggcctgctcatcgcctgctacgtgatcaccgggaccagcgccgacctgaccgtggagaaggcggccgacgtcacgtgggaggaggaggccgagcagaccggcgtgtcccacaacctgatgatcaccgtggacgacgacgggaccatgcggatcaaggacgacgagacggagaacatcctcaccgtcctgctgaagaccgccctcctgatcgtgagcggcatcttcccctactccatcccggccaccctgctcgtgtggcacacctggcagaagcagacgcagcgcagcggcgtcctgtgggacgtgccctccccccccgagacccagaaggcggagctggaggagggggtgtaccggatcaagcagcagggcatcttcgggaagacccaggtcggcgtgggggtgcagaaggagggcgtcttccacaccatgtggcacgtgacgcgcggcgccgtgctcacctacaacgggaagcggctggagccgaactgggccagcgtcaagaaggacctgatctcctacggcgggggctggcgcctgagcgcccagtggcggaagggggaggaggtgcaggtgatcgcggtcgagcccggcaagaaccccaagaacttccagaccatgcccggcatcttccagaccacgaccggggagatcggcgccatcgccctcgacttcaagccggggacctccggcagccccatcatcaaccgcgagggcaaggtggtggggctgtacggcaacggggtcgtgaccaagaacggcgggtacgtgagcggcatcgcccagacgaacgccgagcccgacggcccgacccccgagctggaggaggagatgttcaagaagcggaacctcaccatcatggacctgcaccccgggtccggcaagacccgcaagtacctgcccgcgatcgtccgggaggccatcaagcgccggctccgcacgctgatcctggccccgacccgggtggtggccgccgagatggaggaggcgctcaaggggctgcccatccgctaccagaccaccgccacgaagagcgagcacaccggcaaggagatcgtcgacctgatgtgccacgccaccttcaccatgcggctcctgtcccccgtgcgcgtgcccaactacaacctgatcatcatggacgaggcccacttcacggacccggccagcatcgcggcccgggggtacatctccacccgcgtcggcatgggcgaggccgccgcgatcttcatgaccgccaccccccccgggacggccgacgccttcccccagagcaacgccccgatccaggacgaggagcgcgacatccccgagcggtcctggaacagcggcaacgactggatcaccgacttcgcggggaagaccgtgtggttcgtgccctccatcaaggccggcaacgacatcgccaactgcctccgcaagaacgggaagaaggtcatccagctgagccggaagaccttcgacacggagtaccagaagaccaagctgaacgactgggacttcgtggtgaccaccgacatctccgagatgggcgccaacttcaaggccgaccgcgtcatcgacccccggcgctgcctcaagccggtgatcctgacggacggccccgagcgggtgatcctggcggggcccatgcccgtcaccgtggccagcgccgcccagcgccggggccgcgtggggcggaacccgcagaaggagaacgaccagtacatcttcaccggccagcccctcaacaacgacgaggaccacgcccactggaccgaggcgaagatgctgctggacaacatcaacacgcccgaggggatcatccccgccctcttcgagccggagcgcgagaagtccgccgccatcgacggcgagtaccggctgaagggcgagagccgcaagaccttcgtcgagctgatgcggcgcggggacctccccgtgtggctggcgcacaaggtcgcctccgagggcatcaagtacaccgaccggaagtggtgcttcgacggggagcgcaacaaccagatcctggaggagaacatggacgtggagatctggaccaaggagggcgagaagaagaagctccggccccgctggctggacgcccgcacctacagcgaccccctggccctcaaggagttcaaggacttcgccgcgggccggaagtccatcgccctggacctggtgacggagatcgggcgcgtcccgagccacctcgcccaccggacccgcaacgccctggacaacctggtgatgctccacacctccgagcacggcgggcgggcctaccgccacgcggtggaggagctgcccgagaccatggagacgttcctgctcctgggcctgatgatcctcctgaccgggggcgccatgctgttcctcatcagcggcaagggggtcggcaagaccagcatcgggctgatctgcgtggtggcctccagcggcatgctgtggatggccgacatccccctccagtggatcgcctccgcgatcgtcctggagttcttcatgatggtgctgctcatcccggagcccgagaagcagcggaccccccaggacaaccagctggcctacgtggtcatcgggatcctgacgctcgccgccatcgtggccgcgaacgagatgggcctgctggagaccaccaagcgcgacctcggcatgagcaaggagcccggggtggtctccccgaccagctacctggacgtggacctgcaccccgcctccgcctggacgctctacgccgtggcgaccaccgtcatcacccccatgctgcggcacacgatcgagaacagcaccgccaacgtgtccctggccgccatcgccaaccaggcggtggtcctcatgggcctggacaaggggtggcccatcagcaagatggacctgggcgtgccgctcctggccctggggtgctactcccaggtgaaccccctcaccctgaccgccgccgtcctgctcctggtgacgcactacgccatcatcggccccggcctgcaggcgaaggccacccgcgaggcccagaagcggaccgccgccgggatcatgaagaaccccaccgtggacggcatcatgacgatcgacctcgacccggtcatctacgacagcaagttcgagaagcagctggggcaggtgatgctgctcgtgctgtgcgcggtccagctgctcctgatgcgcacctcctgggccttctgcgaggccctgaccctcgccaccggccccatcacgaccctgtgggagggcagccccgggaagttctggaacaccaccatcgcggtgtccatggccaacatcttccggggcagctacctggccggggccggcctcgccttctccatcatgaagagcgtggggacgggcaagcgcggcaccgggtcccagggcgagaccctgggggagaagtggaagaagaagctgaaccagctcagccggaaggagttcgacctgtacaagaagagcggcatcaccgaggtcgaccgcacggaggcgaaggaggggctgaagcggggcgagaccacccaccacgccgtgtcccgcggcagcgccaagctccagtggttcgtggagcggaacatggtcatccccgaggggcgcgtgatcgacctgggctgcgggcggggcgggtggtcctactactgcgccggcctgaagaaggtgaccgaggtccgcggctacaccaaggggggcccggggcacgaggagcccgtgcccatgagcacgtacggctggaacatcgtgaagctcatgtccgggaaggacgtcttctacctgcccccggagaagtgcgacaccctgctgtgcgacatcggcgagagctcccccagccccaccgtggaggagtcccgcaccatccgggtgctcaagatggtcgagccctggctgaagaacaaccagttctgcatcaaggtgctgaacccgtacatgcccacggtgatcgagcacctcgagcgcctgcagcggaagcacggcgggatgctggtccgcaaccccctcagccggaactccacccacgagatgtactggatcagcaacggcaccgggaacatcgtgtccagcgtgaacatggtctcccgcctgctgctcaaccggttcaccatgacgtaccgccggcccaccatcgagaaggacgtggacctgggcgccggcacccgccacgtcaacgcggagccggagacccccaacatggacgtgatcggggagcggatccgccggatcaaggaggagcacagctccacgtggcactacgacgacgagaacccctacaagacctgggcctaccacggcagctacgaggtgaaggccaccgggtccgccagcagcatgatcaacggcgtcgtgaagctgctcaccaagccgtgggacgtggtccccacggtgacccagatggccatgaccgacaccacgcccttcgggcagcagcgcgtgttcaaggagaaggtcgacacccggacccccaagccgatgcccggcacccgcaaggtgatggagatcacggcggagtggctgtggcggaccctgggccgcaacaagcggccccgcctctgcacccgcgaggagttcaccaagaaggtgcggacgaacgccgccatgggggccgtcttcaccgaggagaaccagtgggactccgcgcgcgccgccgtggaggacgaggagttctggaagctggtggaccgggagcgcgagctgcacaagcagggcaagtgcgggagctgcgtctacaacatgatgggcaagcgggagaagaagctcggggagttcggcaaggccaagggctcccgcgccatctggtacatgtggctgggggcgcggtacctggagttcgaggccctcggcttcctgaacgaggaccactggttcagccgcgagaactcctacagcggggtggagggcgaggggctgcacaagctcggctacatcctgcgggacatctccaagatccccggcggggccatgtacgccgacgacaccgccggctgggacacccgcatcacggaggacgacctgcacaacgaggagaagatcacccagcagatggacccggagcaccggcagctcgcgaacgccatcttcaagctgacctaccagaacaaggtggtcaaggtgcagcgccccacccccaaggggacggtgatggacatcatcagccggaaggaccagcgcggctccggccaggtcgggacctacggcctgaacaccttcaccaacatggaggcccagctcatccggcagatggagggggagggcgtgctgagcaagaccgacctggagaacccccacctcctggagaagaagatcatccagtggctggagacgaagggggtggagcgcctcaagcggatggccatctccggcgacgactgcgtcgtgaagccgatcgacgaccgcttcgccaacgcgctgctggccctcaacgacatgggcaaggtgcggaaggacatcccccagtggcagcccagccgcgggtggcacgactggcagcaggtccccttctgctcccaccacttccacgagctgatcatgaaggacggccggaagctggtggtgccgtgccgcccccaggacgagctcatcgggcgcgcccggatcagccagggcgccgggtggtccctgaaggagaccgcctgcctgggcaaggcgtacgcccagatgtgggccctcatgtacttccaccgccgggacctgcgcctggccagcaacgcgatctgctccgccgtccccgtgcactgggtgcccaccagccggaccacgtggtccatccacgcccaccaccagtggatgaccaccgaggacatgctcaccgtctggaaccgcgtgtggatcgaggacaacccgtggatggaggacaagacgcccgtgaccacctgggaggacgtcccctacctgggcaagcgggaggaccagtggtgcgggagcctgatcggcctcaccagccgcgccacgtgggcccagaacatcctgaccgcgatccagcaggtgcggtccctgatcgggaacgaggagttcctcgactacatgcccagcatgaagcgcttccggaaggaggaggagtccgagggcgccatctggtga

SEQ ID NO: 10390 - RNA, 9873 nt, synthetic construct
  misc_feature 1..9873: note = derived and/or modified CDS sequence (opt1) from DENV-3__AY858044__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcctccgggatcaacatgtgcaccctcatcgccatggacctgggggagatgtgcgacgacaccatcacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtggagacgtgggccttccgccaccccgggttcaccatcctcgcgctgttcctggcccactacatcggcacctccctcacccagaaggtggtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtgtgcaagcacacctacgtcgaccgggggtggggcaacgggtgcggcctcttcgggaagggctccctggtgacctgcgccaagttccagtgcctggagctcatcgagggcaaggtggtccagcacgagaacctgaagtacaccgtgatcatcacggtgcacaccggggaccagcaccaggtcggcaacgagacccagggggtgaccgccgagatcacgccccaggccagcaccgtcgaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtgaccttcaagaacgcccacgccaagaagcaggaggtcgtggtgctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtcctcaagaaggaggtgagcgagacccagcacgggacgatcctgatcaaggtggagtacaagggcgaggacgccccctgcaagatcccgttcagcaccgaggacgggcagggcaaggcccacaacggccggctgatcaccgccaaccccgtcgtgaccaagaaggaggagcccgtgaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacctggatcggcctcaactccaagaacacgagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacctggacggagcagtacaagttccaggccgacagccccaagcggctggccaccgccatcgccggcgcgtgggagaacggggtgtgcggcatccgctccaccacccgcatggagaacctgctctggaagcagatcgccaacgagctgaactacatcctgtgggagaacaacatcaagctcacggtcgtggtgggggacatcatcggcgtcctggagcagggcaagcggaccctgacgccccagcccatggagctcaagtacagctggaagacctgggggaaggccaagatcgtgacggccgagatccagaactccagcttcatcatcgacggcccgaacacccccgagtgccccaacgcgtcccgcgcctggaacgtgtgggaggtcgaggactacgggttcggcgtgttcaccaccaacatctggctgaagctgcgggagatgtacacgcagctctgcgaccaccgcctgatgagcgccgccgtgaaggacgagcgggccgtccacgcggacatgggctactggatcgagagccagaagaacgggtcctggaagctggagaaggccagcctcatcgaggtgaagacctgcacctggcccaagtcccacaccctgtggagcaacggcgtgctggagtccgacatgatcatccccaagtccctcgccgggcccatctcccagcacaactaccgccccggctaccacacccagacggccgggccgtggcacctgggcaagctggagctcgacttcaactactgcgagggcaccaccgtcgtgatcaccgagaactgcgggacgcggggccccagcctgcgcaccaccaccgtgtccgggaagctgatccacgagtggtgctgccggagctgcacgctgccgcccctccgctacatgggcgaggacgggtgctggtacggcatggagatccggccgatcaacgagaaggaggagaacatggtcaagtccctggtgagcgccggctccgggaaggtggacaacttcaccatgggcgtcctctgcctggcgatcctgttcgaggaggtgatgcgcgggaagttcggcaagaagcacatgatcgccggggtcctcttcatgttcgtcctgctgctcagcggccagatcacctggcgggacatggcccgcaccctgatcatgatcggctccaacgccagcgaccggatggggatgggcgtgacgtacctggccctcatcgcgaccttcaagatccagcccttcctggccctggggttcttcctccgcaagctgacctcccgggagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctggtcagcctgacgtgcagcaacaccatcttcaccctcaccgtggcctggcgcacggcgaccctgatcctggccgggatctccctcctgcccgtgtgccagagctccagcatgcggaagaccgactggctgccgatgaccgtcgccgccatgggcgtgccgcccctccccctgttcatcttctccctgaaggacacgctcaagcgccgcagctggccgctgaacgagggggtcatggccgtgggcctggtgtccatcctcgcgagctccctgctgcggaacgacgtccccatggccggccccctcgtggccgggggcctgctgatcgcctgctacgtgatcaccgggaccagcgccgacctcaccgtcgagaaggcggccgacgtgacgtgggaggaggaggccgagcagaccggcgtgtcccacaacctgatgatcaccgtcgacgacgacgggaccatgcgcatcaaggacgacgagacggagaacatcctgaccgtgctcctgaagaccgccctgctcatcgtgagcggcatcttcccctactccatcccggccaccctgctggtctggcacacctggcagaagcagacgcagcggagcggcgtgctctgggacgtgcccagcccgcccgagacccagaaggcggagctggaggagggggtctaccgcatcaagcagcagggcatcttcgggaagacccaggtgggcgtgggggtccagaaggagggcgtgttccacaccatgtggcacgtgacgcggggcgccgtcctgacctacaacgggaagcgcctcgagccgaactgggccagcgtgaagaaggacctgatctcctacggcgggggctggcggctgagcgcccagtggcagaagggggaggaggtgcaggtcatcgcggtggagcccggcaagaaccccaagaacttccagaccatgcccggcatcttccagaccacgaccggggagatcggcgccatcgccctggacttcaagccggggacctccggcagccccatcatcaaccgcgagggcaaggtggtcgggctctacggcaacggggtggtgaccaagaacggcgggtacgtcagcggcatcgcccagacgaacgccgagcccgacggcccgacccccgagctggaggaggagatgttcaagaagcggaacctgaccatcatggacctccaccccgggtccggcaagacccgcaagtacctgcccgcgatcgtgcgggaggccatcaagcgccggctgcgcacgctcatcctggccccgacccgggtggtcgccgccgagatggaggaggcgctgaaggggctccccatccgctaccagaccaccgccaccaagagcgagcacaccggcaaggagatcgtggacctgatgtgccacgccaccttcaccatgcggctgctctcccccgtgcgcgtccccaactacaacctgatcatcatggacgaggcccacttcacggacccggccagcatcgcggcccgggggtacatctccacccgcgtgggcatgggcgaggccgccgcgatcttcatgaccgccacgccgcccgggacggccgacgccttcccccagagcaacgccccgatccaggacgaggagcgggacatccccgagcgctcctggaacagcggcaacgactggatcaccgacttcgcggggaagaccgtgtggttcgtcccctccatcaaggccggcaacgacatcgccaactgcctgcgcaagaacgggaagaaggtgatccagctcagccggaagaccttcgacacggagtaccagaagaccaagctgaacgactgggacttcgtggtcaccaccgacatctccgagatgggcgccaacttcaaggccgaccgcgtgatcgacccccggcgctgcctgaagccggtgatcctcacggacggccccgagcgggtcatcctggcggggcccatgcccgtgaccgtggccagcgccgcccagcgccggggccgcgtcgggcggaacccgcagaaggagaacgaccagtacatcttcaccggccagcccctgaacaacgacgaggaccacgcccactggaccgaggcgaagatgctcctggacaacatcaacacgcccgaggggatcatccccgccctgttcgagccggagcgcgagaagtccgccgccatcgacggcgagtaccggctcaagggcgagagccgcaagaccttcgtggagctgatgcggcgcggggacctgcccgtgtggctcgcgcacaaggtcgcctccgagggcatcaagtacaccgaccggaagtggtgcttcgacggggagcgcaacaaccagatcctggaggagaacatggacgtggagatctggaccaaggagggcgagaagaagaagctgcggccccgctggctcgacgcccggacctacagcgaccccctggccctgaaggagttcaaggacttcgccgcgggccgcaagtccatcgccctcgacctggtcacggagatcgggcgcgtgccgagccacctggcccaccggacccgcaacgccctcgacaacctggtgatgctgcacacctccgagcacggcgggcgggcctaccgccacgcggtcgaggagctccccgagaccatggagacgctgctgctcctgggcctgatgatcctcctgaccgggggcgccatgctgttcctcatcagcggcaagggggtgggcaagaccagcatcgggctgatctgcgtggtcgcctccagcggcatgctgtggatggccgacatccccctccagtggatcgcctccgcgatcgtgctggagttcttcatgatggtgctgctcatcccggagcccgagaagcagcggacgccccaggacaaccagctggcctacgtcgtgatcgggatcctgacgctcgccgccatcgtggccgcgaacgagatgggcctgctggagaccaccaagcgcgacctcggcatgagcaaggagcccggggtcgtgtccccgaccagctacctggacgtggacctgcaccccgcctccgcctggacgctctacgccgtcgcgaccaccgtgatcacccccatgctgcggcacacgatcgagaacagcaccgccaacgtgtccctggccgccatcgccaaccaggcggtcgtgctcatgggcctggacaaggggtggcccatcagcaagatggacctgggcgtgccgctcctggccctggggtgctactcccaggtcaaccccctcaccctgaccgccgccgtgctgctcctggtgacgcactacgccatcatcggccccggcctgcaggcgaaggccacccgcgaggcccagaagcggaccgccgccgggatcatgaagaaccccaccgtcgacggcatcatgacgatcgacctcgacccggtgatctacgacagcaagttcgagaagcagctgggccaggtgatgctgctcgtcctgtgcgcggtgcagctgctcctgatgcgcacctcctgggccttctgcgaggccctgaccctcgccaccggccccatcacgaccctgtgggagggcagccccgggaagttctggaacaccaccatcgcggtgtccatggccaacatcttccggggcagctacctggccggggccggcctcgccttctccatcatgaagtccgtcgggacgggcaagcgcggcaccgggtcccagggcgagaccctgggggagaagtggaagaagaagctgaaccagctcagccggaaggagttcgacctgtacaagaagtccggcatcaccgaggtggaccgcacggaggcgaaggaggggctgaagcggggcgagaccacccaccacgccgtgtcccgcggcagcgccaagctccagtggttcgtcgagcggaacatggtgatccccgaggggcgcgtgatcgacctgggctgcgggcggggcgggtggtcctactactgcgccggcctgaagaaggtcaccgaggtgcgcggctacaccaagggcgggccggggcacgaggagcccgtgcccatgagcacgtacggctggaacatcgtcaagctcatgtccgggaaggacgtgttctacctgcccccggagaagtgcgacaccctgctgtgcgacatcggcgagagctcccccagccccaccgtggaggagtcccggaccatccgcgtcctcaagatggtggagccctggctgaagaacaaccagttctgcatcaaggtgctgaacccgtacatgcccacggtcatcgagcacctcgagcgcctgcagcggaagcacggcgggatgctggtgcgcaaccccctcagccggaactccacccacgagatgtactggatcagcaacggcaccgggaacatcgtgtccagcgtcaacatggtgtcccgcctgctgctcaaccggttcaccatgacgtaccgccggcccaccatcgagaaggacgtggacctgggcgccggcacccgccacgtcaacgcggagccggagacccccaacatggacgtgatcggggagcggatccgccggatcaaggaggagcacagctccacgtggcactacgacgacgagaacccctacaagacctgggcctaccacggcagctacgaggtcaaggccaccgggtccgccagcagcatgatcaacggcgtggtgaagctgctcaccaagccgtgggacgtcgtgcccacggtgacccagatggccatgaccgacaccacgcccttcgggcagcagcgcgtcttcaaggagaaggtggacacccggacccccaagccgatgcccggcacccgcaaggtgatggagatcacggcgggctggctgtggcggaccctggggcgcaacaagcggccccgcctctgcacccgggaggagttcaccaagaaggtccgcacgaacgccgccatgggcgccgtgttcaccgaggagaaccagtgggactccgcgcgcgccgccgtggaggacgaggagttctggaagctggtcgaccgggagcgcgagctgcacaagcaggggaagtgcggcagctgcgtgtacaacatgatggggaagcgggagaagaagctcggcgagttcggcaaggccaaggggtcccgcgccatctggtacatgtggctgggcgcgcggtacctggagttcgaggccctcgggttcctgaacgaggaccactggttcagccgcgagaactcctacagcggcgtggagggggagggcctgcacaagctcggctacatcctgcgggacatctccaagatccccgggggcgccatgtacgccgacgacaccgccgggtgggacacccgcatcacggaggacgacctgcacaacgaggagaagatcacccagcagatggacccggagcaccggcagctcgcgaacgccatcttcaagctgacctaccagaacaaggtcgtgaaggtgcagcgccccacccccaagggcacggtcatggacatcatcagccggaaggaccagcgcggctccggccaggtgggcacctacgggctgaacaccttcaccaacatggaggcccagctcatccggcagatggagggcgagggggtgctgagcaagaccgacctggagaacccccacctcctggagaagaagatcacgcagtggctggagaccaagggcgtcgagcgcctcaagcggatggccatctccggcgacgactgcgtggtgaagccgatcgacgaccgcttcgccaacgcgctgctggccctcaacgacatggggaaggtccggaaggacatcccccagtggcagcccagcaagggctggcacgactggcagcaggtccccttctgctcccaccacttccacgagctgatcatgaaggacgggcgcaagctggtggtcccgtgccggccccaggacgagctcatcggccgcgcccggatcagccagggggccggctggtccctgaaggagaccgcctgcctgggcaaggcgtacgcccagatgtgggccctcatgtacttccaccgccgcgacctgcggctggccagcaacgcgatctgctccgccgtgcccgtgcactgggtccccaccagccgcacgacctggtccatccacgcccaccaccagtggatgaccaccgaggacatgctcacggtgtggaaccgggtgtggatcgaggacaacccgtggatggaggacaagacccccgtcaccacctgggaggacgtgccctacctggggaagcgcgaggaccagtggtgcggcagcctgatcgggctcacgagccgggccacctgggcccagaacatcctgaccgcgatccagcaggtccgctccctgatcggcaacgaggagttcctcgactacatgcccagcatgaagcggttccgcaaggaggaggagtccgagggggccatctggtga

SEQ ID NO: 10391 - RNA, 9873 nt, synthetic construct
  misc_feature 1..9873: note = derived and/or modified CDS sequence (opt1) from DENV-3__AY858045__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcctccgggatcaacatgtgcaccctcatcgccatggacctgggggagatgtgcgacgacaccatcacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcgccaggtggagaaggtggagacgtgggccttccgccaccccgggttcaccatcctcgcgctgttcctggcccactacatcggcacctccctcacccagaaggtcgtgatcttcatcctgctgatgctcgtgacgcccagcatgaccatgcggtgcgtcggggtgggcaaccgcgacttcgtggagggcctgtccggggccacctgggtcgacgtggtgctggagcacggcgggtgcgtcaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtgtgcaagcacacctacgtcgaccgggggtggggcaacgggtgcggcctcttcgggaagggctccctggtgacctgcgccaagttccagtgcctggagctcatcgagggcaaggtggtccagcacgagaacctgaagtacaccgtgatcatcacggtgcacaccggggaccagcaccaggtcggcaacgagacccagggggtgaccgccgagatcacgccccaggccagcaccgtcgaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtgaccttcaagaacgcccacgccaagaagcaggaggtcgtggtgctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtcctcaagaaggaggtgagcgagacccagcacgggacgatcctgatcaaggtggagtacaagggcgaggacgccccctgcaagatcccgttcagcaccgaggacgggcagggcaaggcccacaacggccggctgatcaccgccaaccccgtcgtgaccaagaaggaggagcccgtgaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtcggcggggtgctgaactccctgggcaagatggtgcaccagatcttcgggagcgcctacaccgccatcttctccggcgtcagctggatcatgaagatcggcatcggggtgctcctgacctggatcggcctgaactccaagaacacgagcatgtccttcagctgcatcgtgatcgggatcatcaccctctacctgggcgccgtcgtgcaggcggacatggggtgcgtgatcaactggaagggcaaggagctgaagtgcggctccgggatcttcgtcaccaacgaggtgcacacctggacggagcagtacaagttccaggccgacagccccaagcggctcgccaccgccatcgccggcgcgtgggagaacggggtgtgcggcatccgctccaccacccgcatggagaacctgctgtggaagcagatcgccaacgagctcaactacatcctgtgggagaacaacatcaagctgacggtcgtggtgggggacatcatcggcgtcctcgagcagggcaagcggaccctgacgccccagcccatggagctgaagtacagctggaagacctgggggaaggccaagatcgtgacggccgagatccagaactccagcttcatcatcgacggcccgaacacccccgagtgccccaacgcgtcccgcgcctggaacgtgtgggaggtcgaggactacgggttcggcgtgttcaccaccaacatctggctcaagctgcgggagatgtacacgcagctgtgcgaccaccgcctcatgagcgccgccgtgaaggacgagcgggccgtccacgcggacatgggctactggatcgagagccagaagaacgggtcctggaagctggagaaggccagcctgatcgaggtgaagacctgcacctggcccaagtcccacaccctctggagcaacggcgtgctggagtccgacatgatcatccccaagtccctggccgggcccatctcccagcacaactaccgccccggctaccacacccagacggccgggccgtggcacctcggcaagctggagctggacttcaactactgcgagggcaccaccgtcgtgatcaccgagaactgcgggacgcggggccccagcctccgcaccaccaccgtgtccgggaagctgatccacgagtggtgctgccggagctgcacgctgccgcccctgcgctacatgggcgaggacgggtgctggtacggcatggagatccggccgatcaacgagaaggaggagaacatggtcaagtccctggtgagcgccggctccgggaaggtggacaacttcaccatgggcgtcctgtgcctcgcgatcctgttcgaggaggtgatgcgcgggaagttcggcaagaagcacatgatcgccggggtgctgttcatgttcgtcctcctgctgagcggccagatcacctggcgggacatggcccgcaccctcatcatgatcggctccaacgccagcgaccggatggggatgggcgtgacgtacctggccctgatcgcgaccttcgagatccagcccttcctcgccctggggttcttcctgcgcaagctcacctcccgggagaacctgctgctcggcgtgggcctggccatggccaccacgctgcagctccccgaggacatcgagcagatggcgaacgggatcgccctgggcctgatggccctcaagctgatcacccagttcgagacctaccagctgtggaccgccctcgtcagcctgacgtgcagcaacaccatcttcaccctgaccgtggcctggcgcacggcgaccctcatcctggccgggatctccctgctccccgtgtgccagagctccagcatgcggaagaccgactggctgccgatgaccgtcgccgccatgggcgtgccgcccctgcccctcttcatcttctccctgaaggacacgctgaagcgccgcagctggccgctcaacgagggggtcatggccgtgggcctggtgtccatcctggcgagctccctcctgcggaacgacgtccccatggccggccccctggtggccgggggcctcctgatcgcctgctacgtgatcaccgggaccagcgccgacctgaccgtcgagaaggcggccgacgtgacgtgggaggaggaggccgagcagaccggcgtgtcccacaacctcatgatcaccgtcgacgacgacgggaccatgcgcatcaaggacgacgagacggagaacatcctgaccgtgctgctcaagaccgccctgctgatcgtgagcggcatcttcccctactccatcccggccaccctcctggtctggcacacctggcagaagcagacgcagcggagcggcgtgctgtgggacgtgcccagcccgcccgagacccagaaggcggagctcgaggagggggtctaccgcatcaagcagcagggcatcttcgggaagacccaggtgggcgtgggggtccagaaggagggcgtgttccacaccatgtggcacgtgacgcggggcgccgtcctgacctacaacgggaagcgcctggagccgaactgggccagcgtgaagaaggacctcatctcctacggcgggggctggcggctgagcgcccagtggcagaagggggaggaggtgcaggtcatcgcggtggagcccggcaagaaccccaagaacttccagaccatgcccggcatcttccagaccacgaccggggagatcggcgccatcgccctggacttcaagccggggacctccggcagccccatcatcaaccgcgagggcaaggtggtcgggctgtacggcaacggggtggtgaccaagaacggcgggtacgtcagcggcatcgcccagacgaacgccgagcccgacggcccgacccccgagctcgaggaggagatgttcaagaagcggaacctgaccatcatggacctgcaccccgggtccggcaagacccgcaagtacctccccgcgatcgtgcgggaggccatcaagcgccggctgcgcacgctgatcctcgccccgacccgggtggtcgccgccgagatggaggaggcgctgaaggggctgcccatccgctaccagaccaccgccaccaagagcgagcacaccggcaaggagatcgtggacctcatgtgccacgccaccttcaccatgcggctgctgtcccccgtgcgcgtccccaactacaacctcatcatcatggacgaggcccacttcacggacccggccagcatcgcggcccgggggtacatctccacccgcgtgggcatgggcgaggccgccgcgatcttcatgaccgccacgccgcccgggacggccgacgccttcccccagagcaacgccccgatccaggacgaggagcgggacatccccgagcgctcctggaacagcggcaacgactggatcaccgacttcgcggggaagaccgtgtggttcgtcccctccatcaaggccggcaacgacatcgccaactgcctgcgcaagaacgggaagaaggtgatccagctgagccggaagaccttcgacacggagtaccagaagaccaagctcaacgactgggacttcgtggtcaccaccgacatctccgagatgggcgccaacttcaaggccgaccgcgtgatcgacccccggcgctgcctgaagccggtgatcctgacggacggccccgagcgggtcatcctcgcggggcccatgcccgtgaccgtggccagcgccgcccagcgccggggccgcgtcgggcggaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgcgagaagtccgccgccatcgacggcgagtaccggctgaagggcgagagccgcaagaccttcgtggagctcatgcggcgcggggacctgcccgtgtggctggcgcacaaggtcgcctccgagggcatcaagtacaccgaccggaagtggtgcttcgacggggagcgcaacaaccagatcctcgaggagaacatggacgtggagatctggaccaaggagggcgagaagaagaagctgcggccccgctggctggacgcccggacctacagcgaccccctcgccctgaaggagttcaaggacttcgccgcgggccgcaagtccatcgccctggacctcgtcacggagatcgggcgcgtgccgagccacctggcccaccggacccgcaacgccctggacaacctcgtgatgctgcacacctccgagcacggcgggcgggcctaccgccacgcggtcgaggagctgcccgagaccatggagacgctcctgctgctcggcctgatgatcctgctcaccgggggcgccatgctgttcctgatcagcggcaagggggtgggcaagaccagcatcgggctcatctgcgtggtcgcctccagcggcatgctgtggatggccgacatccccctgcagtggatcgcctccgcgatcgtgctcgagttcttcatgatggtgctgctgatcccggagcccgagaagcagcggacgccccaggacaaccagctcgcctacgtcgtgatcgggatcctgacgctggccgccatcgtggccgcgaacgagatgggcctcctggagaccaccaagcgcgacctgggcatgagcaaggagcccggggtcgtgtccccgaccagctacctcgacgtggacctgcaccccgcctccgcctggacgctgtacgccgtcgcgaccaccgtgatcacccccatgctccggcacacgatcgagaacagcaccgccaacgtgtccctggccgccatcgccaaccaggcggtcgtgctgatgggcctcgacaaggggtggcccatcagcaagatggacctgggcgtgccgctgctcgccctggggtgctactcccaggtcaaccccctgaccctcaccgccgccgtgctgctgctcgtgacgcactacgccatcatcggccccggcctgcaggcgaaggccacccgcgaggcccagaagcggaccgccgccgggatcatgaagaaccccaccgtcgacggcatcatgacgatcgacctggacccggtgatctacgacagcaagttcgagaagcagctcggccaggtgatgctgctggtcctctgcgcggtgcagctgctgctcatgcgcacctcctgggccttctgcgaggccctgaccctggccaccggccccatcacgaccctctgggagggcagccccgggaagttctggaacaccaccatcgcggtgtccatggccaacatcttccggggcagctacctggccggggccggcctggccttctccatcatgaagtccgtcgggacgggcaagcgcggcaccgggtcccagggcgagaccctcggggagaagtggaagaagcggctgaaccagctgagccgcaaggagttcgacctctacaagaagtccggcatcaccgaggtggaccggacggaggcgaaggaggggctgaagcgcggcgagatcacccaccacgccgtgtcccggggcagcgccaagctgcagtggttcgtcgagcgcaacatggtgatccccgaggggcgggtgatcgacctcggctgcgggcgcggcgggtggtcctactactgcgccggcctgaagaaggtcaccgaggtgcggggctacaccaagggcgggccggggcacgaggagcccgtgcccatgagcacctacggctggaacatcgtcaagctgatgtccgggaaggacgtgttctacctcccgcccgagaagtgcgacacgctgctgtgcgacatcggcgagagctcccccagccccaccgtggaggagtcccgcaccatccgcgtcctgaagatggtggagccctggctcaagaacaaccagttctgcatcaaggtgctgaacccctacatgcccaccgtcatcgagcacctggagcggctccagcgcaagcacggcgggatgctggtgcggaaccccctgagccgcaactccacgcacgagatgtactggatcagcaacggcaccgggaacatcgtgtccagcgtcaacatggtgtcccggctcctgctgaaccgcttcaccatgacctaccggcgccccacgatcgagaaggacgtggacctcggcgccggcacccggcacgtcaacgcggagccggagacccccaacatggacgtgatcggggagcgcatccggcgcatcaaggaggagcacagctccacctggcactacgacgacgagaacccctacaagacgtgggcctaccacggcagctacgaggtcaaggccaccgggtccgccagcagcatgatcaacggcgtggtgaagctgctgaccaagccgtgggacgtcgtgcccaccgtgacgcagatggccatgaccgacaccacccccttcgggcagcagcgggtcttcaaggagaaggtggacacgcgcacccccaagccgatgcccggcacccggaaggtgatggagatcaccgcgggctggctctggcgcacgctggggcggaacaagcgcccccggctgtgcacccgcgaggagttcaccaagaaggtccgcaccaacgccgccatgggcgccgtgttcacggaggagaaccagtgggactccgcgcgggccgccgtggaggacgaggagttctggaagctcgtcgaccgcgagcgggagctgcacaagcaggggaagtgcggcagctgcgtgtacaacatgatggggaagcgcgagaagaagctgggcgagttcggcaaggccaaggggtcccgggccatctggtacatgtggctcggcgcgcgctacctggagttcgaggccctggggttcctcaacgaggaccactggttcagccgggagaactcctacagcggcgtggagggggagggcctgcacaagctgggctacatcctccgcgacatctccaagatccccgggggcgccatgtacgccgacgacaccgccgggtgggacacccggatcaccgaggacgacctgcacaacgaggagaagatcacgcagcagatggacccggagcaccgccagctggcgaacgccatcttcaagctcacctaccagaacaaggtcgtgaaggtgcagcggcccacccccaagggcaccgtcatggacatcatcagccgcaaggaccagcggggctccggccaggtgggcacgtacgggctgaacaccttcaccaacatggaggcccagctgatccgccagatggagggcgagggggtgctcagcaagaccgacctggagaacccccacctcctcgagaagaagatcacccagtggctggagacgaagggcgtcgagcggctgaagcgcatggccatctccggcgacgactgcgtggtgaagccgatcgacgaccggttcgccaacgcgctcctggccctgaacgacatggggaaggtccgcaaggacatcccccagtggcagcccagcaagggctggcacgactggcagcaggtccccttctgctcccaccacttccacgagctcatcatgaaggacgggcggaagctggtggtcccgtgccgcccccaggacgagctgatcggccgggcccgcatcagccagggggccggctggtccctcaaggagaccgcctgcctgggcaaggcgtacgcccagatgtgggccctgatgtacttccaccgccgggacctccgcctggccagcaacgcgatctgctccgccgtgcccgtgcactgggtccccaccagccggaccacgtggtccatccacgcccaccaccagtggatgaccaccgaggacatgctgaccgtgtggaaccgcgtgtggatcgaggacaacccgtggatggaggacaagacgcccgtcaccacctgggaggacgtgccctacctcgggaagcgggaggaccagtggtgcggcagcctgatcgggctgaccagccgcgccacgtgggcccagaacatcctcaccgcgatccagcaggtccggtccctgatcggcaacgaggagttcctggactacatgcccagcatgaagcgcttccggaaggaggaggagtccgagggggccatctggtga

SEQ ID NO: 10392 - RNA, 9873 nt, synthetic construct
  misc_feature 1..9873: note = derived and/or modified CDS sequence (opt1) from DENV-3__AY858046__SS-prME
  source 1..9873: mol_type = other RNA
accagcctgtgcctcatgatgatgctgcccgccaccctggccttccacctcaccagccgcgacggggagccccggatgatcgtggggaagaacgagcgcggcaagagcctgctgttcaagaccgcctccgggatcaacatgtgcaccctcatcgccatggacctgggcgagatgtgcgacgacaccatcacctacaagtgccccctgatcaccgaggtggagcccgaggacatcgactgctggtgcaacctcaccagcacctgggtgacgtacgggacctgcaaccaggtgggcgagcaccggcgcgacaagcggtccgtcgccctggcgccccacgtgggcatggggctggacacccgcgcccagacctggatgagcgcggagggcgcctggcggcaggtcgagaaggtcgagacgtgggccttccgccaccccgggttcaccatcctcgccctgttcctggcgcactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggccacgctccggaagctgtgcatcgagggcaagatcaccaacgtgaccaccgacagccgctgccccacgcagggcgaggcgatcctgccggaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggccatcctgcccgagtacggcaccctcgggctggagtgcagcccccgcaccggcctggacttcaacgagatgatcctcctgaccatgaagaacaaggcgtggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgccatgcacaccgcgctgaccggggccacggagatccagaccagcggcgggacctccatcttcgccggccacctgaagtgccgcctcaagatggacaagctggagctgaagggcatgagctacgccatgtgctccaacgccttcgtgctcaagaaggaggtgagcgagacccagcacgggacgatcctgatcaaggtcgagtacaagggcgaggacgcgccctgcaagatcccgttcagcaccgaggacgggcagggcaaggcccacaacggccggctgatcaccgccaaccccgtggtgaccaagaaggaggagcccgtcaacatcgaggccgagcccccgttcggggagtccaacatcatcatcggcatcggggacaaggcgctgaagatcaactggtacaagaagggcagctccatcgggaagatgttcgaggccacggcccgcggcgcccggcgcatggccatcctcggcgacaccgcgtgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggccgacatggggtgcgtcatcaactggaagggcaaggagctcaagtgcggctccgggatcttcgtgaccaacgaggtgcacacctggacggagcagtacaagttccaggcggacagccccaagcggctggccaccgccatcgccggcgcctgggagaacggggtctgcggcatccgctccaccacccgcatggagaacctgctctggaagcagatcgcgaacgagctgaactacatcctgtgggagaacaacatcaagctcacggtggtggtcggggacatcatcggcgtgctggagcagggcaagcggaccctgacgccccagcccatggagctcaagtacagctggaagacctgggggaaggccaagatcgtgacggccgagatccagaactccagcttcatcatcgacggcccgaacacccccgagtgccccaacgcctcccgcgcgtggaacgtctgggaggtggaggactacgggttcggcgtgttcaccaccaacatctggctgaagctgcgggagatgtacacgcagctctgcgaccaccgcctgatgagcgccgccgtcaaggacgagcgggccgtgcacgccgacatgggctactggatcgagagccagaagaacgggtcctggaagctggagaaggcgagcctcatcgaggtgaagacctgcacctggcccaagtcccacaccctgtggagcaacggcgtcctggagtccgacatgatcatccccaagtccctcgccgggcccatctcccagcacaactaccgccccggctaccacacccagacggccgggccgtggcacctgggcaagctggagctcgacttcaactactgcgagggcaccaccgtggtgatcaccgagaactgcgggacgcggggccccagcctgcgcaccaccaccgtctccgggaagctgatccacgagtggtgctgccggagctgcacgctgccgcccctccgctacatgggcgaggacgggtgctggtacggcatggagatccggccgatcaacgagaaggaggagaacatggtgaagtccctggtgagcgccggctccgggaaggtcgacaacttcaccatgggcgtgctctgcctggccatcctgttcgaggaggtgatgcgcgggaagttcggcaagaagcacatgatcgcgggggtcctcttcatgttcgtgctgctgctcagcggccagatcacctggcgggacatggcccgcaccctgatcatgatcggctccaacgccagcgaccggatggggatgggcgtgacgtacctggccctcatcgccaccttcaagatccagcccttcctggcgctggggttcttcctccgcaagctgacctcccgggagaacctgctcctgggcgtcggcctggccatggccaccacgctccagctgcccgaggacatcgagcagatggccaacgggatcgcgctgggcctcatggccctgaagctgatcacccagttcgagacctaccagctctggaccgccctggtgagcctgacgtgcagcaacaccatcttcaccctcaccgtggcctggcgcacggccaccctgatcctggcggggatctccctcctgcccgtctgccagagctccagcatgcggaagaccgactggctgccgatgaccgtggccgccatgggcgtgccgcccctgcccctgttcatcttctccctgaaggacacgctcaagcgccgcagctggccgctgaacgagggggtgatggccgtgggcctggtctccatcctcgccagctccctgctgcggaacgacgtgcccatggcgggccccctcgtggccgggggcctgctgatcgcctgctacgtcatcaccgggaccagcgccgacctcaccgtggagaaggccgcggacgtgacgtgggaggaggaggccgagcagaccggcgtctcccacaacctgatgatcaccgtggacgacgacgggaccatgcgcatcaaggacgacgagacggagaacatcctgaccgtgctcctgaagaccgccctgctcatcgtcagcggcatcttcccctactccatcccggccaccctgctggtgtggcacacctggcagaagcagacgcagcggagcggcgtgctctgggacgtccccagcccgcccgagacccagaaggccgagctggaggagggggtgtaccgcatcaagcagcagggcatcttcgggaagacccaggtgggcgtcggggtgcagaaggagggcgtgttccacaccatgtggcacgtcacgcggggcgcggtgctgacctacaacgggaagcgcctcgagccgaactgggccagcgtgaagaaggacctgatctcctacggcgggggctggcggctgagcgcccagtggcagaagggggaggaggtccaggtgatcgccgtggagcccggcaagaaccccaagaacttccagaccatgcccggcatcttccagaccacgaccggggagatcggcgcgatcgccctggacttcaagccggggacctccggcagccccatcatcaaccgcgagggcaaggtcgtggggctctacggcaacggggtggtcaccaagaacggcgggtacgtgagcggcatcgcccagacgaacgccgagcccgacggcccgacccccgagctggaggaggagatgttcaagaagcggaacctgaccatcatggacctccaccccgggtccggcaagacccgcaagtacctgcccgccatcgtgcgggaggcgatcaagcgccggctgcgcacgctcatcctggccccgacccgggtcgtggccgccgagatggaggaggccctgaaggggctccccatccgctaccagaccaccgcgaccaagagcgagcacaccggcaaggagatcgtggacctgatgtgccacgccaccttcaccatgcggctgctctcccccgtccgcgtgcccaactacaacctgatcatcatggacgaggcccacttcacggacccggccagcatcgccgcgcgggggtacatctccacccgcgtgggcatgggcgaggccgccgccatcttcatgaccgcgacgccgcccgggacggccgacgccttcccccagagcaacgccccgatccaggacgaggagcgggacatccccgagcgctcctggaacagcggcaacgactggatcaccgacttcgccgggaagaccgtctggttcgtgccctccatcaaggcgggcaacgacatcgccaactgcctgcgcaagaacgggaagaaggtgatccagctcagccggaagaccttcgacacggagtaccagaagaccaagctgaacgactgggacttcgtcgtgaccaccgacatctccgagatgggcgccaacttcaaggccgaccgcgtgatcgacccccggcgctgcctgaagccggtcatcctcacggacggccccgagcgggtgatcctggccgggcccatgcccgtgaccgtcgcgagcgccgcccagcgccggggccgcgtggggcggaacccgcagaaggagaacgaccagtacatcttcaccggccagcccctgaacaacgacgaggaccacgcccactggaccgaggccaagatgctcctggacaacatcaacacgcccgaggggatcatccccgcgctgttcgagccggagcgcgagaagtccgccgccatcgacggcgagtaccggctcaagggcgagagccgcaagaccttcgtggagctgatgcggcgcggggacctgcccgtctggctcgcccacaaggtggcgtccgagggcatcaagtacaccgaccggaagtggtgcttcgacggggagcgcaacaaccagatcctggaggagaacatggacgtcgagatctggaccaaggagggcgagaagaagaagctgcggccccgctggctcgacgcccggacctacagcgaccccctggccctgaaggagttcaaggacttcgccgccggccgcaagtccatcgcgctcgacctggtgacggagatcgggcgcgtgccgagccacctggcccaccggacccgcaacgccctcgacaacctggtcatgctgcacacctccgagcacggcgggcgggcctaccgccacgccgtggaggagctccccgagaccatggagacgctgctgctcctgggcctgatgatcctcctgaccgggggcgcgatgctgttcctcatcagcggcaagggggtgggcaagaccagcatcgggctgatctgcgtcgtggcctccagcggcatgctgtggatggccgacatccccctccagtggatcgcctccgccatcgtgctggagttcttcatgatggtcctgctcatcccggagcccgagaagcagcggacgccccaggacaaccagctggcgtacgtggtgatcgggatcctgacgctcgccgccatcgtcgccgccaacgagatgggcatgctggagaccaccaagcgcgacctgggcatgagcaaggagcccggggtggtgtccccgaccagctacctcgacgtcgacctgcaccccgcgtccgcctggacgctgtacgccgtggccaccaccgtgatcacccccatgctccggcacacgatcgagaacagcaccgcgaacgtctccctggccgccatcgccaaccaggccgtggtgctgatgggcctcgacaaggggtggcccatcagcaagatggacctgggcgtcccgctgctcgcgctggggtgctactcccaggtgaaccccctgaccctcaccgccgccgtgctgctgctcgtcacgcactacgccatcatcggccccggcctgcaggccaaggcgacccgcgaggcccagaagcggaccgccgccgggatcatgaagaaccccaccgtggacggcatcatgacgatcgacctggacccggtgatctacgacagcaagttcgagaagcagctcgggcaggtcatgctgctggtgctctgcgccgtgcagctgctgctcatgcgcacctcctgggcgttctgcgaggccctgaccctggccaccggccccatcacgaccctctgggagggcagccccgggaagttctggaacaccaccatcgccgtctccatggcgaacatcttccggggcagctacctggccggggccggcctggccttctccatcatgaagtccgtggggacgggcaagcgcggcaccgggtcccagggcgagaccctcggggagaagtggaagaagaagctgaaccagctgagccggaaggagttcgacctctacaagaagtccggcatcaccgaggtggaccgcacggaggccaaggaggggctgcggcgcggcgagatcacccaccacgcggtctcccggggcagcgccaagctgcagtggttcgtggagcgcaacatggtgatccccgaggggcgggtcatcgacctcggctgcgggcgcggcgggtggtcctactactgcgccggcctgaagaaggtgaccgaggtgcggggctacaccaagggcgggccggggcacgaggagcccgtccccatgagcacctacggctggaacatcgtgaagctgatgtccgggaaggacgtgttctacctcccgcccgagaagtgcgacacgctgctgtgcgacatcggcgagagctcccccagccccaccgtcgaggagtcccgcaccatccgcgtgctgaagatggtggagccctggctcaagaacaaccagttctgcatcaaggtcctgaacccctacatgcccaccgtgatcgagcacctggagcggctccagcgcaagcacggcgggatgctggtgcggaaccccctgagccgcaactccacgcacgagatgtactggatcagcaacggcaccgggaacatcgtctccagcgtgaacatggtgtcccggctcctgctgaaccgcttcaccatgacctaccggcgccccacgatcgagaaggacgtcgacctcggcgccggcacccggcacgtgaacgccgagccggagacccccaacatggacgtcatcggggagcgcatccggcgcatcaaggaggagcacagctccacctggcactacgacgacgagaacccctacaagacgtgggcgtaccacggcagctacgaggtgaaggccaccgggtccgccagcagcatgatcaacggcgtggtcaagctgctgaccaagccgtgggacgtggtgcccaccgtcacgcagatggccatgaccgacaccacccccttcgggcagcagcgggtgttcaaggagaaggtggacacgcgcacccccaagccgatgcccggcacccggaaggccatggagatcaccgcgggctggctctggcgcacgctggggcggaacaagcgcccccggctgtgcacccgcgaggagttcaccaagaaggtccgcaccaacgccgccatgggcgccgtgttcacggaggagaaccagtgggactccgcgcgggccgccgtggaggacgaggagttctggaagctcgtcgaccgcgagcgggagctgcacaagcaggggaagtgcggcagctgcgtgtacaacatgatggggaagcgcgagaagaagctgggcgagttcggcaaggccaaggggtcccgggccatctggtacatgtggctcggcgcgcgctacctggagttcgaggccctggggttcctcaacgaggaccactggttcagccgggagaactcctacagcggcgtggagggggagggcctgcacaagctgggctacatcctccgcgacatctccaagatccccgggggcgccatgtacgccgacgacaccgccgggtgggacacccggatcaccgaggacgacctgcacaacgaggagaagatcacgcagcagatggacccggagcaccgccagctggcgaacgccatcttcaagctcacctaccagaacaaggtcgtgaaggtgcagcggcccacccccaagggcaccgtcatggacatcatcagccgcaaggaccagcggggctccggccaggtgggcacgtacgggctgaacaccttcaccaacatggaggtgcagctgatccgccagatggagggcgagggggtcctcagcaagaccgacctggagaacccccacctcctcgagaagaagatcacccagtggctggagacgaagggcgtggagcggctgaagcgcatggccatctccggcgacgactgcgtggtcaagccgatcgacgaccggttcgccaacgccctcctggcgctgaacgacatggggaaggtgcgcaaggacatcccccagtggcagcccagcaagggctggcacgactggcagcaggtccccttctgctcccaccacttccacgagctcatcatgaaggacgggcggaagctggtcgtgccgtgccgcccccaggacgagctgatcggccgggcccgcatcagccagggggccggctggtccctcaaggagaccgcctgcctgggcaaggcctacgcgcagatgtgggccctgatgtacttccaccgccgggacctccgcctggccagcaacgccatctgctccgcggtgcccgtccactgggtgcccaccagccggaccacgtggtccatccacgcccaccaccagtggatgaccaccgaggacatgctgaccgtgtggaaccgcgtctggatcgaggacaacccgtggatggaggacaagacgcccgtgaccacctgggaggacgtgccctacctcgggaagcgggaggaccagtggtgcggcagcctgatcgggctgaccagccgcgccacgtgggcccagaacatcctcaccgccatccagcaggtccggtccctgatcggcaacgaggagttcctggactacatgcccagcatgaagcgcttccggaaggaggaggagtccgagggggcgatctggtga

SEQ ID NO: 10393 - RNA, 9873 nt, synthetic construct
  misc_feature 1..9873: note = derived and/or modified CDS sequence (opt1) from DENV-3__AY858047__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcgcgcagacctggatgagcgccgagggcgcctggcggcaggtcgagaaggtggagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgcccgaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatccccttcagcaccgaggacgggcagggcaaggcccacaacggccggctgatcaccgccaaccccgtggtgaccaagaaggaggagcccgtcaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggcggacatggggtgcgtcatcaactggaagggcaaggagctcaagtgcggctccgggatcttcgtgaccaacgaggtgcacacctggacggagcagtacaagttccaggccgacagccccaagcggctggccaccgccatcgccggcgcgtgggagaacggggtctgcggcatccgctccaccacccgcatggagaacctgctctggaagcagatcgccaacgagctgaactacatcctgtgggagaacaacatcaagctcacggtggtggtcggggacatcatcggcatcctggagcagggcaagcggaccctgacgccccagcccatggagctcaagtacagctggaagacctgggggaaggccaagatcgtgacggccgagatccagaactccagcttcatcatcgacggcccgaacacccccgagtgccccaacgcgtcccgcgcctggaacgtgtgggaggtcgaggactacgggttcggcgtgttcaccaccaacatctggctgaagctgcgggagatgtacagccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacgtgcacctggcccaagagccacaccctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcacgaccgtcgtgatcaccgagaactgcgggacccggggcccctccctgcgcacgaccaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggtggacaacttcacgatgggcgtcctctgcctggcgatcctgttcgaggaggtgatgcgcgggaagttcggcaagaagcacatgatcgccggggtcctcttcaccttcgtcctgctgctctccggccagatcacctggcgggacatggcccgcaccctgatcatgatcggcagcaacgcctccgaccggatggggatgggcgtgacgtacctggccctcatcgcgaccttcaagatccagcccttcctggccctggggttcttcctccgcaagctgaccagccgggagaacctgctcctgggcgtgggcctggccatggccaccacgctccagctgcccgaggacatcgagcagatggcgaacgggatcgccctgggcctcatggccctgaagctgatcacccagttcgagacctaccagctctggaccgccctggtcagcctgatgtgctccaacacgatcttcaccctcaccgtggcctggcgcaccgcgacgctgatcctggccgggatcagcctcctgcccctgtgccagtccagctccatgcggaagaccgactggctcccgatgaccgtggccgccatgggcgtgccgcccctgcccctgttcatcttcagcctcaaggacaccctgaagcgccgctcctggccgctgaacgagggggtgatggccgtcggcctcgtgagcatcctggcgtccagcctgctccggaacgacgtgcccatggccggccccctggtcgccgggggcctgctcatcgcctgctacgtgatcacggggacctccgccgacctgaccgtggagaaggcggccgacgtcacctgggaggaggaggccgagcagacgggcgtgagccacaacctgatgatcaccgtggacgacgacgggaccatgcgcatcaaggacgacgagaccgagaacatcctcacggtcctgctgaagaccgccctcctgatcgtgtccggcatcttcccctacagcatcccggccaccctgctcgtgtggcacacctggcagaagcggacccagcgctccggcgtcctgtgggacgtgccctccccgcccgagacgcagaaggcggagctggaggagggggtgtaccggatcaagcagcagggcatcctcgggaagacccaggtcggcgtgggggtgcagaaggagggcgtcttccacaccatgtggcacgtgacccgcggcgccgtgctgacgtacaacgggaagcggctggagccgaactgggcctccgtcaagaaggacctgatcagctacggcgggggctggcgcctctccgcccagtggcagaagggggaggaggtccaggtgatcgcggtcgagcccggcaagaaccccaagaacttccagaccatgcccggcatcttccagaccaccacgggggagatcggcgccatcgccctggacttcaagccggggaccagcggcagccccatcatcaaccgggagggcaaggtggtggggctgtacggcaacggggtcgtgaccaagaacggcgggtacgtgtccggcatcgcccagaccaacgccgagcccgacggcccgacgcccgagctcgaggaggagatgttcaagaagcgcaacctgaccatcatggacctgcaccccgggagcggcaagacccggaagtacctccccgcgatcgtccgcgaggccatcaagcggcgcctgcggaccctgatcctcgccccgacgcgcgtggtggccgccgagatggaggaggcgctgaaggggctgcccatccggtaccagaccaccgccaccaagtccgagcacacgggcaaggagatcgtcgacctcatgtgccacgccaccttcaccatgcgcctgctgagccccgtgcgggtgcccaactacaacctcatcatcatggacgaggcccacttcaccgacccggcctccatcgcggcccgcgggtacatcagcacgcgggtcggcatgggcgaggccgccgcgatcttcatgaccgccacgccgcccgggaccgccgacgccttcccccagtccaacgccccgatccaggacgaggagcgcgacatccccgagcgcagctggaactccggcaacgactggatcacggacttcgcggggaagaccgtgtggttcgtgcccagcatcaaggccggcaacgacatcgccaactgcctgcggaagaacgggaagaaggtcatccagctgtcccgcaagaccttcgacaccgagtaccagaagacgaagctcaacgactgggacttcgtggtgaccaccgacatcagcgagatgggcgccaacttcaaggccgaccgggtcatcgacccccgccggtgcctgaagccggtgatcctgaccgacggccccgagcgcgtgatcctcgcggggcccatgcccgtcacggtggcctccgccgcccagcggcgcggccgggtggggcgcaacccgcagaaggagaacgaccagtacatcttcaccggccagcccctgaacaacgacgaggaccacgcccactggaccgaggcgaagatgctgctcgacaacatcaacacccccgaggggatcatccccgccctgttcgagccggagcgggagaagtccgccgccatcgacggcgagtaccgcctgaagggcgagtcccggaagacgttcgtcgagctcatgcgccgcggggacctgcccgtgtggctggcgcacaaggtggccagcgagggcatcaagtacaccgaccgcaagtggtgcttcgacggggagcggaacaaccagatcctcgaggagaacatggacgtcgagatctggaccaaggagggcgagaagaagaagctgcgcccccggtggctggacgcccgcacctactccgaccccctcgccctgaaggagttcaaggacttcgccgcgggccgcaagagcatcgccctggacctcgtgaccgagatcgggcgggtcccgtcccacctggcccaccgcacgcggaacgccctggacaacctcgtgatgctgcacaccagcgagcacggcgggcgcgcctaccggcacgcggtggaggagctgcccgagaccatggagaccctcctgctgctcggcctgatgatcctgctcaccggcggggtcatgctgttcctgatcagcgggaagggggtgggcaagacctccatcgggctcatctgcgtggtcgccagctccggcatgctgtggatggccgacatccccctgcagtggatcgccagcgccatcgtgctcgagttcttcatgatggtgctgctgatcccggagcccgagaagcagcgcacgccccaggacaaccagctcgcgtacgtcgtgatcgggatcctgaccctggccgccatcgtggccgccaacgagatgggcctcctggagacgaccaagcgggacctgggcatgtccaaggagcccggggtcgcgagcccgacctcctacctcgacgtggacctgcaccccgccagcgcctggaccctgtacgccgtggcgacgaccgtcatcacccccatgctccgccacaccatcgagaactccacggccaacgtgagcctggccgccatcgccaaccaggcggtggtcctgatgggcctcgacaaggggtggcccatctccaagatggacctgggcgtgccgctgctcgccctggggtgctacagccaggtgaaccccctgaccctcaccgccgccgtcctgctgctcgtgacccactacgccatcatcggccccggcctgcaggcgaaggccacgcgggaggcccagaagcgcaccgccgccgggatcatgaagaaccccaccgtggacggcatcatgaccatcgacctggacccggtcatctacgactccaagttcgagaagcagctcggccaggtgatgctgctggtgctctgcgcggtccagctgctgctcatgcggacgagctgggccttctgcgaggccctgaccctggccaccggccccatcaccacgctctgggagggctcccccgggaagttctggaacaccaccatcgcggtgagcatggccaacatcttccgcggctcctacctggccggggccggcctggccttcagcatcatgaagtccgtggggaccggcaagcggggcacggggagccagggcgagaccctcggggagaagtggaagaagaagctgaaccagctgagccgcaaggagttcgacctctacaagaagtccggcatcaccgaggtcgaccggaccgaggcgaaggaggggctgaagcgcggcgagatcacgcaccacgccgtgagccggggctccgccaagctgcagtggttcgtggagcgcaacatggtcatccccgaggggcgggtgatcgacctcggctgcgggcgcggcgggtggagctactactgcgccggcctgaagaaggtgaccgaggtccggggctacaccaagggcgggccggggcacgaggagcccgtgcccatgtccacctacggctggaacatcgtgaagctgatgagcgggaaggacgtcttctacctgcccccggagaagtgcgacaccctcctgtgcgacatcggcgagtccagcccctcccccacggtggaggagagccgcaccatccgcgtgctgaagatggtcgagccctggctcaagaacaaccagttctgcatcaaggtgctgaacccgtacatgcccgccgtgatcgagcacctggagcggctccagcgcaagcacggcgggatgctggtccggaaccccctgtcccgcaacagcacccacgagatgtactggatctccaacggcaccgggaacatcgtgagctccgtgaacatggtcagccggctcctgctgaaccgcttcacgatgacctaccggcgccccaccatcgagaaggacgtggacctcggcgcgggcacccggcacgtgaacgccgagccggagacgcccaacatggacgtcatcggggagcgcatccggcgcatcaaggaggagcactccagcacctggcactacgacgacgagaacccctacaagacctgggcctaccacggctcctacgaggtgaaggccaccgggagcgccagctccatgatcaacggcgtcgtgaagctgctgacgaagccgtgggacgtggtccccaccgtgacccagatggcgatgaccgacacgacccccttcgggcagcagcgggtgttcaaggagaaggtcgacacccgcacccccaagccgatgcccggcacgcggaaggtgatggagatcaccgccgagtggctctggcgcaccctgggccggaacaagcgcccccggctgtgcacccgcgaggagttcacgaagaaggtgcgcaccaacgccgccatgggggcggtcttcaccgaggagaaccagtgggacagcgccaaggccgccgtggaggacgaggagttctggaagctcgtggaccgggagcgcgagctgcacaagctgggcaagtgcgggtcctgcgtctacaacatgatgggcaagcgggagaagaagctcggggagttcggcaaggccaagggcagccgcgcgatctggtacatgtggctgggggcccggtacctggagttcgaggccctcggcttcctgaacgaggaccactggttctcccgcgagaacagctactccggggtggagggcgaggggctgcacaagctcggctacatcctgcgggacatcagcaagatccccggcggggccatgtacgccgacgacaccgcgggctgggacacgcgcatcaccgaggacgacctgcacaacgaggagaagatcacccagcagatggacccggagcaccggcagctcgccaacgccatcttcaagctgacctaccagaacaaggtggtcaaggtgcagcgccccacgcccaaggggaccgtgatggacatcatctcccggaaggaccagcgcggcagcggccaggtcgggacctacggcctgaacaccttcacgaacatggaggcccagctcatccggcagatggagggggagggcgtgctgtccaagaccgacctggagaacccccacctcctggagaagaagatcacccagtggctggagaccaagggggtggagcgcctcaagcggatggccatcagcggcgacgactgcgtcgtgaagccgatcgacgaccgcttcgcgaacgccctgctggccctcaacgacatgggcaaggtgcggaaggacatcccccagtggcagccctccaaggggtggcacgactggcagcaggtccccttctgcagccaccacttccacgagctgatcatgaaggacggccgcaagctggtggtgccgtgccggccccaggacgagctcatcgggcgcgcccggatctcccagggcgccgggtggagcctgaaggagaccgcgtgcctgggcaaggcctacgcccagatgtgggccctcatgtacttccaccgccgcgacctgcggctggcgtccaacgccatctgcagcgccgtccccgtgcactgggtgcccacgtcccgcaccacctggagcatccacgcccaccaccagtggatgaccacggaggacatgctcatcgtctggaaccgggtgtggatcgaggacaacccgtggatggaggacaagacccccgtgaccacctgggaggacgtcccctacctgggcaagcgcgaggaccagtggtgcgggagcctgatcggcctcacgtcccgggccacctgggcgcagaacatcctgaccgccatccagcaggtccgcagcctgatcgggaacgaggagttcctcgactacatgccctccatgaagcggttccgcaaggaggaggagagcgagggcgccatctggtga

SEQ ID NO: 10394 - RNA, 9873 nt, synthetic construct
  misc_feature 1..9873: note = derived and/or modified CDS sequence (opt1) from DENV-3__HQ332170__SS-prME
  source 1..9873: mol_type = other RNA
accagcctgtgcctcatgatgatcctgcccgccgccctggcgttccacctcaccagccgggacggggagccgcggatgatcgtggggaagaacgagcggggcaagagcctgctgttcaagaccgcctccgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacctgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcgcaccggcctggacttcaacgagatgatcctgctcacgatgaagaacaaggcctggatggtgcaccggcagtggttcttcgacctgcccctgccctggaccagcggcgccaccaccgagacgcccacctggaaccgcaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcgccggccacctgaagtgccggctgaagatggacaagctcgagctgaagggcatgagctacgccatgtgcaccaacacgttcgtcctgaagaaggaggtgtccgagacccagcacgggaccatcctcatcaaggtggactacaagggcgaggacgtcccgtgcaagatccccttcagcaccgaggacgggcagggcaaggcgcacaacggccgcctgatcacggccaaccccgtggtgaccaagaaggaggagcccgtcaacatcgaggccgagccgcccttcggggagagcaacatcgtgatcggcatcggggacaacgccctgaagatcaactggtacaagaagggctccagcatcgggaagatgttcgaggcgaccgcccggggcgcccgccggatggccatcctgggcgacaccgcctgggacttcgggtccgtgggcggggtcctcaacagcctgggcaagatggtgcaccagatcttcgggtccgcgtacacggccctgttcagcggcgtgtcctgggtcatgaagatcggcatcggggtgctcctgacctggatcggcctgaacagcaagaacacctccatgagcttctcctgcatcgccatcgggatcatcaccctctacctgggcgccgtggtccaggccgacacggggtgcgtgatcaactggaagggcaaggagctgaagtgcggcagcgggatcttcgtgaccaacgaggtccacacctggaccgagcagtacaagttccaggcggactcccccaagcgcctcgccacggccatcgccggcgcctgggagaacggggtgtgcggcatccgcagcaccacccggatggagaacctgctgtggaagcagatcgcgaacgagctcaactacatcctgtgggagaacaacatcaagctgaccgtggtcgtgggggacatcatcggcgtgctcgagcagggcaagcgcacgctgacgccccagccgatggagctgaagtactcctggaagacctgggggaaggccaagatcgtcaccgccgagacgcagaacagctccttcatcatcgacggccccaacacccccgagtgccccagcgcctcccgggcgtggaacgtgtgggaggtggaggactacgggttcggcgtcttcaccaccaacatctggctcaagctgcgcgaggtgtacacccagcagtgcgaccaccggctgatgagcgccgccgtgaaggacgagcgcgccgtccacgccgacatgggctactggatcgagagccagaagaacgggtcctggaagctcgagaaggcgagcctgatcgaggtgaagacgtgcacctggccgaagtcccacaccctgtggagcaacggcgtgctcgagtccgacatgatcatccccaagagcctggccgggcccatctcccagcacaactaccggccgggctaccacacccagacggccgggccctggcacctgggcaagctcgagctggacttcaactactgcgagggcaccaccgtcgtgatcaccgagaactgcgggacgcgcggccccagcctgcggaccaccaccgtgtccgggaagctcatccacgagtggtgctgccgcagctgcacgctgcccccgctgcggtacatgggcgaggacgggtgctggtacggcatggagatccgccccatctccgagaaggaggagaacatggtcaagagcctcgtgtccgccggcagcggggaggtggacaacttcaccatgggcgtcctgtgcctggccatcctcttcgaggaggtgatgcgggggaagttcggcaagaagcacatgatcgcgggggtgttcttcaccttcgtcctgctgctctccggccagatcacctggcgcgacatggcccacacgctgatcatgatcggcagcaacgcctccgaccggatggggatgggcgtgacctacctggccctcatcgccaccttcaagatccagcccttcctggcgctggggttcttcctccgcaagctgaccagccgggagaacctgctcctgggcgtgggcctggccatggccacgaccctccagctgcccgaggacatcgagcagatggccaacgggatcgcgctgggcctcatggccctgaagctgatcacccagttcgagacctaccagctctggacggccctgatcagcctgacctgctccaacaccatcttcaccctcacggtcgcctggcgcaccgccaccctgatcctggcgggggtgagcctcctgccggtctgccagtccagctccatgcggaagaccgactggctgcccatgacggtggccgccatgggcgtgccgcccctcccgctgttcatcttcagcctgaaggacaccctcaagcgccgctcctggcccctgaacgagggggtcatggccgtgggcctggtgagcatcctcgcctccagcctgctgcggaacgacgtccccatggcgggccccctcgtggccgggggcctgctgatcgcctgctacgtgatcaccgggacctccgccgacctcacggtcgagaaggccgcggacgtgacctgggaggaggaggccgagcagaccggcgtgagccacaacctgatgatcaccgtcgacgacgacgggaccatgcgcatcaaggacgacgagacggagaacatcctgaccgtgctcctgaagaccgccctgctcatcgtgtccggcatcttcccgtacagcatccccgccaccctgctggtctggcacacgtggcagaagcagacccagcggtccggcgtgctctgggacgtgcccagcccgcccgagacccagaaggccgagctggaggagggggtctaccgcatcaagcagcagggcatcttcgggaagacccaggtgggcgtgggggtccagaaggagggcgtgttccacacgatgtggcacgtgacccggggcgcggtcctgacctacaacgggaagcgcctcgagcccaactgggcctccgtgaagaaggacctgatcagctacggcgggggctggcggctgtccgcccagtggcagaagggggaggaggtgcaggtcatcgccgtggagcccggcaagaaccccaagaacttccagaccatgcccggcacgttccagaccaccaccggggagatcggcgcgatcgccctcgacttcaagcccgggacgagcggcagccccatcatcaaccgcgagggcaaggtggtcgggctgtacggcaacggggtggtgaccaagaacggcgggtacgtctccggcatcgcccagaccaacgccgagccggacggccccacccccgagctggaggaggagatgttcaagaagcggaacctgacgatcatggacctccaccccgggagcggcaagacccgcaagtacctgccggccatcgtgcgggaggcgatcaagcgccggctgcgcaccctcatcctggcccccacccgggtggtcgccgccgagatggaggaggccctgaaggggctccccatccgctaccagacgaccgcgaccaagtccgagcacaccggccgggagatcgtggacctgatgtgccacgccacgttcaccatgcgcctgctcagccccgtgcgggtcccgaactacaacctgatcatcatggacgaggcccacttcaccgaccccgcctccatcgccgcgcgcgggtacatcagcacccgggtgggcatgggcgaggccgccgccatcttcatgacggcgacgccgcccgggaccgccgacgccttcccgcagtccaacgcccccatccaggacgaggagcgcgacatccccgagcgcagctggaactccggcaacgagtggatcaccgacttcgccgggaagacggtgtggttcgtccccagcatcaaggcgggcaacgacatcgccaactgcctgcggaagaacgggaagaaggtgatccagctctcccgcaagaccttcgacaccgagtaccagaagaccaagctgaacgactgggacttcgtggtcacgaccgacatcagcgagatgggcgccaacttcaaggccgaccgggtgatcgacccgcgccggtgcctgaagcccgtgatcctcaccgacggccccgagcgcgtcatcctggccgggcccatgccggtgaccgcggcctccgccgcccagcggcgcggccgggtggggcgcaacccccagaaggagaacgaccagtacatcttcaccggccagcccctgaacaacgacgaggaccacgcccactggacggaggcgaagatgctcctggacaacatcaacacccccgaggggatcatcccggccctgttcgagcccgagcgggagaagtccgccgccatcgacggcgagtaccgcctcaagggcgagtcccggaagaccttcgtcgagctgatgcgccgcggggacctgcccgtgtggctcgcgcacaaggtcgccagcgagggcatcaagtacaccgaccgcaagtggtgcttcgacgggcagcggaacaaccagatcctggaggagaacatggacgtggagatctggacgaaggagggcgagaagaagaagctgcgcccccggtggctcgacgcccgcacctactccgacccgctggccctgaaggagttcaaggacttcgccgcgggccgcaagagcatcgccctcgacctggtgaccgagatcgggcgggtcccctcccacctggcccaccgcacccggaacgccctcgacaacctggtgatgctgcacacgagcgagcacggcgggaaggcctaccgccacgcggtggaggagctccccgagaccatggagaccctgctgctcctgggcctgatgatcctcctgaccgggggcgccatgctgttcctcatcagcggcaaggggatcggcaagacgtccatcgggctgatctgcgtcatcgccagctccggcatgctgtggatggccgagatcccgctccagtggatcgccagcgcgatcgtgctggagttcttcatgatggtgctgctcatccccgagcccgagaagcagcggacgccccaggacaaccagctggcctacgtcgtgatcgggatcctgaccctcgccgccatcatcgccgcgaacgagatgggcctgctggagaccacgaagcgcgacctcggcatgtccaaggagccgggggtggtcagccccacctcctacctggacgtggacctgcaccccgccagcgcctggaccctctacgccgtggcgaccacggtcatcacccccatgctgcggcacaccatcgagaactccaccgccaacgtgagcctggccgccatcgccaaccaggcggtggtcctcatgggcctggacaaggggtggccgatctccaagatggacctgggcgtgcccctcctggccctggggtgctacagccaggtgaaccccctcacgctgaccgccgccgtcctgctcctgatcacccactacgccatcatcggccccggcctgcaggcgaaggccacccgcgaggcccagaagcggacggccgccgggatcatgaagaacccgaccgtggacggcatcatgaccatcgacctcgaccccgtgatctacgactccaagttcgagaagcagctggggcaggtcatgctgctcgtgctgtgcgcggtgcagctgctcctgatgcgcaccagctgggccctgtgcgaggccctcacgctggccaccggccccatcaccaccctgtgggagggctcccccgggaagttctggaacacgaccatcgcggtcagcatggccaacatcttccggggctcctacctcgccggggccggcctggccttcagcatcatgaagtccgtggggaccggcaagcgcggcaccgggagccagggcgagaccctgggggagaagtggaagaagaagctcaaccagctgagccggaaggagttcgacctgtacaagaagtccggcatcacggaggtggaccgcaccgaggcgaaggaggggctcaagcggggcgagatcacccaccacgccgtcagccgcggctccgccaagctgcagtggttcgtggagcggagcatggtgatcccggaggggcgcgtcatcgacctgggctgcgggcggggcgggtggtcctactactgcgccggcctcaagaaggtgaccgaggtgcgcggctacacgaagggcgggcccgggcacgaggagcccgtccccatgagcacctacggctggaacatcgtgaagctgatgtccgggaaggacgtgttctacctgccgcccgagaagtgcgacaccctcctgtgcgacatcggcgagagctcccccagccccaccgtcgaggagtcccggacgatccgcgtgctgaagatggtggagccgtggctgaagaacaaccagttctgcatcaaggtcctcaacccctacatgcccaccgtgatcgagcacctggagcgcctgcagcggaagcacggcgggatgctcgtgcgcaaccccctgagccggaactccacccacgagatgtactggatcagcaacggcaccgggaacatcgtcgcctccgtgaacatggtgagccgcctgctcctgaaccggttcacgatgacccaccgccggccgaccatcgagaaggacgtcgacctgggcgcgggcacccgccacgtgaacgccgagcccgagacgcccaacatggacgtgatcggggagcggatcaagcgcatcaaggaggagcacaactccacctggcactacgacgacgagaacccgtacaagacctgggcctaccacggcagctacgaggtcaaggccaccgggtccgccagcagcatgatcaacggcgtggtcaagctcctgacgaagccctgggacgtggtgcccatggtcacccagatggcgatgaccgacaccacgcccttcgggcagcagcgggtgttcaaggagaaggtggacacccgcaccccgcggtccatgcccggcacccgccgggtcatgggcatcacggccgagtggctgtggcgcaccctcgggcggaacaagaagccccgcctgtgcacccgggaggagttcaccaagaaggtgcgcacgaacgccgccatgggcgcggtgttcaccgaggagaaccagtgggacagcgccaaggccgccgtcgaggacgaggacttctggaagctggtggaccgcgagcgggagctccacaagctggggaagtgcggctcctgcgtgtacaacatgatggggaagcgcgagaagaagctgggcgagttcggcaaggccaaggggagccgggcgatctggtacatgtggctcggcgcccgctacctggagttcgaggccctggggttcctcaacgaggaccactggttctcccgggagaacagctactccggcgtcgagggggagggcctgcacaagctgggctacatcctccgcgacatcagcaagatccccgggggcgccatgtacgccgacgacaccgcggggtgggacacccggatcacggaggacgacctgcacaacgaggagaagatcacccagcagatggacccggagcacaagcagctggccaacgccatcttcaagctcacctaccagaacaaggtggtgaaggtccagcgccccacccccaccggcacggtgatggacatcatctcccggaaggaccagcgcggcagcggccaggtgggcacctacgggctgaacaccttcaccaacatggaggcccagctgatccggcagatggagggcgagggggtcctctccaaggccgacctggagaacccccacctccccgagaagaagatcacgcagtggctggagaccaagggcgtggagcgcctgaagcggatggcgatcagcggcgacgactgcgtggtcaagcccatcgacgaccgcttcgccaacgccctgctcgccctgaacgacatggggaaggtgcggaaggacatcccccagtggcagccctccaagggctggcacgactggcagcaggtcccgttctgcagccaccacttccacgagctgatcatgaaggacgggcgcaagctcgtcgtgccctgccggccccaggacgagctgatcggccgcgcccggatctcccagggggcgggctggagcctgcgcgagaccgcctgcctcggcaaggcctacgcccagatgtggtccctgatgtacttccaccggcgcgacctgcgcctcgcgagcaacgccatctgctccgccgtgcccgtccactgggtgccgaccagccggacgacctggagcatccacgcccaccaccagtggatgaccaccgaggacatgctgacggtgtggaaccgcgtctggatcgaggacaacccctggatggaggacaagacccccgtgaccacctgggagaacgtgccctacctggggaagcgggaggaccagtggtgcggctccctcatcgggctgacgagccgcgccacctgggcgcagaacatcccgaccgccatccagcaggtccggtccctgatcggcaacgaggagttcctcgactacatgcccagcatgaagcgcttccggaaggaggaggagtccgagggggccatctggtga

SEQ ID NO: 10395 - RNA, 9873 nt, synthetic construct
  misc_feature 1..9873: note = derived and/or modified CDS sequence (opt1) from DENV-3__AY858038__SS-prME
  source 1..9873: mol_type = other RNA
accagcctgtgcctcatgatgatgctgcccgccaccctggccttccacctcaccagccgggacggcgagccgcggatgatcgtggggaagaacgagcggggcaagagcctgctgttcaagaccgcctccgggatcaacatgtgcaccctcatcgccatggacctgggcgagatgtgcgacgacaccgtgacgtacaagtgccccctgatcaccgaggtggagcccgaggacatcgactgctggtgcaacctcaccagcacctgggtgacgtacgggacctgcaaccaggccggcgagcaccggcgcgacaagcggtccgtggccctggcgccccacgtgggcatggggctggacacccgcacccagacgtggatgagcgcggagggcgcctggcgccaggtggagaaggtggagacctgggccttccgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgccggaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagcacgagaacctcaagtacacggtgatcatcaccgtccacaccggggaccagcaccaggtgggcaacgagacccagggggtcacggccgagatcacgccccaggcctccaccgtggaggccatcctgcccgagtacggcaccctggggctcgagtgcagcccccgcaccggcctggacttcaacgagatgatcctgctcacgatgaagaacaaggcgtggatggtgcaccggcagtggttcttcgacctgccgctgccctggacctccggcgccaccaccgagacgcccacctggaacaagaaggagctcctggtcaccttcaagaacgcccacgccaagaagcaggaggtggtggtcctggggagccaggagggcgccatgcacaccgcgctcacgggggccaccgagatccagacctccggcgggaccagcatcttcgccggccacctgaagtgccgcctgaagatggacaagctcgagctgaagggcatgtcctacgccatgtgcctgaacgccttcgtgctcaagaaggaggtgagcgagacgcagcacgggaccatcctgatcaaggtcgagtacaagggcgaggacgcgccctgcaagatcccgttcagcaccgaggacgggcagggcaaggcccacaacggccggctgatcaccgccaaccccgtggtgacgaagaaggaggagcccgtcaacatcgaggccgagcccccgttcggggagtccaacatcgtgatcggcatcggggacaaggcgctgaagatcaactggtacaagaagggcagctccatcgggaagatgttcgaggccaccgcccgcggcgcccggcgcatggccatcctcggcgacaccgcgtgggacttcgggagcgtgggcggggtcctgaactccctgggcaagatggtgcaccagatcttcgggagcgcctacaccgccctcttctccggcgtgagctggatcatgaagatcggcatcggggtcctgctgacgtggatcggcctcaactccaagaacaccagcatgtccttcagctgcatcgccatcgggatcatcaccctgtacctgggcgccgtggtgcaggcggacatggggtgcgtcatcaactggaagggcaaggagctcaagtgcggctccgggatcttcgtgaccaacgaggtgcacacgtggaccgagcagtacaagttccaggccgacagccccaagcggctggccaccgccatcgccggcgcgtgggagaacggggtctgcggcatccgctccaccacgcgcatggagaacctgctctggaagcagatcgccaacgagctgaactacatcctgtgggagaacaacatccggctcaccgtggtggtcggggacaccatcggcgtgctgcagcagggcaagcgcaccctgccgccccagccgatggagctcaagtacagctggaagacgtgggggaaggccaagatcgtgaccgccaagacccagaactccagcttcatcatcgacggccccaacacccccgagtggccctccgcgagccgggcctggaacgtctgggaggtggaggactacgggttcggcgtgttcacgaccaacatctggctgaagctgcgcgagatgtacacccagctctgcgaccaccggctgatgagcgccgccgtcaaggacgagcgcgccgtgcacgcggacatgggctactggatcgagtcccagaagaacgggagctggaagctggagaaggcctccctcatcgaggtgaagacctgcacctggcccaagagccacacgctgtggtccaacggcgtcctggagagcgacatgatcatccccaagtccctcgccgggcccatcagccagcacaactaccggccgggctaccacacccagaccgccgggccctggcacctgggcaagctggagctcgacttcaactactgcgagggcaccacggtggtgatcaccgagaactgcgggacccgcggcccctccctgcggaccacgaccgtcagcgggaagctgatccacgagtggtgctgccgctcctgcaccctgccgcccctgcggtacatgggcgaggacgggtgctggtacggcatggagatccgccccatcaacgagaaggaggagaacatggtcaagagcctggtgtccgccggcagcgggaaggtcgacaacttcaccatgggcgtgctctgcctggcgatcctgttcgaggaggtgatgcgggggaagttcggcaagaagcacatgatcgccggggtcctcttcacgttcgtgctgctgctctccggccagatcacctggcgcgacatggcccggaccctgatcatgatcggcagcaacgcctccgaccgcatggggatgggcgtgacctacctggccctcatcgcgacgttcaagatccagcccttcctggccctggggttcttcctccggaagctgaccagccgcgagaacctgctcctgggcgtcggcctggccatggccaccaccctccagctgcccgaggacatcgagcagatggcgaacgggatcgccctgggcctcatggccctgaagctggtgacgcagttcgagacctaccagctctggaccgccctggtgagcctgatgtgctccaacaccatcttcacgctcaccgtcgcctggcggaccgcgaccctgatcctggccgggatcagcctcctgcccgtgtgccagtccagctccatgcgcaagacggactggctgcccatgaccgtcgccgccatgggcgtgccgcccctcccgctgttcatcttcagcctgaaggacaccctcaagcgccggtcctggcccctgaacgagggggtgatggccgtcggcctggtgagcatcctcgcgtccagcctgctgcgcaacgacgtgcccatggccggccccctcgtcgccgggggcctgctgatcgcctgctacgtgatcaccgggacgtccgccgacctcaccgtggagaaggcggccgacgtcatctgggaggaggaggccgagcagaccggcgtgagccacaacctgatgatcaccgtggacgacgacgggacgatgcggatcaaggacgacgagaccgagaacatcctgaccgtcctcctgaagaccgccctgctcatcgtgtccggcatcttcccgtacagcatccccgccaccctgctggtgtggcacacgtggcagaagcagacccagcgctccggcgtcctctgggacgtgcccagcccgcccgagacccagaaggcggagctggaggagggggtgtaccggatcaagcagcagggcatcttcgggaagacccaggtcggcgtgggggtgcagaaggagggcgtcttccacacgatgtggcacgtgacccgcggcgccgtgctgacccacaacgggaagcggctcgagcccaactgggcctccgtcaagaaggacctgatcagctacggcgggggctggcgcctgtccgcccagtggcagaagggggaggaggtccaggtgatcgcggtcgagcccggcaagaaccccaagaacttccagaccatgcccggcatcttccagacgaccaccggggagatcggcgccatcgccctggacttcaagcccgggaccagcggcagccccatcatcaaccgggagggcaaggtggtggggctctacggcaacggggtcgtgacgaagaacggcgggtacgtgtccggcatcgcccagaccaacgccgagccggacggccccacccccgagctggaggaggagatgttcaagaagcgcaacctgaccatcatggacctccaccccgggagcggcaagacgcggaagtacctgccggcgatcatccgcgaggccatcaagcggcgcctgcggaccctcatcctggcccccacccgcgtcgtggccgccgagatggaggaggcgctgaaggggctccccatccggtaccagaccacggccaccaagtccgagcacaccggcaaggagatcgtggacctgatgtgccacgccaccttcacgatgcgcctgctcagccccgtccgggtgccgaactacaacctgatcatcatggacgaggcccacttcaccgaccccgcctccatcgcggcccgcgggtacatcagcacccgggtgggcatgggcgaggccgccgcgatcttcatgaccgccacgccgcccgggaccgccgacgccttcccgcagtccaacgcccccatccaggacgaggagcgcgacatccccgagcgcagctggaactccggcaacgactggatcaccgacttcgcggggaagaccgtctggttcgtgcccagcatcaaggccggcaacgacatcgccaactgcctgcggaagaacgggaagaaggtgatccagctctcccgcaagacgttcgacaccgagtaccagcggaccaagctgaacgactgggacttcgtcgtgaccacggacatcagcgagatgggcgccaacttcaaggccgaccgcgtgatcgacccgcggcgctgcctgaagcccgtcatcctcaccgacggccccgagcgggtgatcctggcggggcccatgccggtgaccgtcgcctccgccgcccagcgccggggccgcgtggggcggaacccccagaaggagaacgaccagtacatcttcaccggccagcccctgaacaacgacgaggaccacgcccactggacggaggcgaagatgctcctggacaacatcaacacccccgaggggatcatcccggccctgttcgagcccgagcgcgagaagtccgccgccatcgacggcgagtaccggctcaagggcgagtcccgcaagaccttcgtggagctgatgcggcgcggggacctgcccgtctggctcgcgcacaaggtggccagcgagggcatcaagtacaccgaccggaagtggtgcttcgacggggagcgcaacaaccagatcctggaggagaacatggacgtcgagatctggaccaaggagggcgagaagaagaagctgcggccccgctggctcgacgcccgcacgtactccgacccgctggccctgaaggagttcaaggacttcgccgcgggccgcaagagcatcgccctcgacctggtgaccgagatcgggcgcgtgccctcccacctggcccaccggacccgcaacgccctcgacaacctggtcatgctgcacaccagcgagcacggcgggcgggcctaccgccacgcggtggaggagctccccgagacgatggagaccctgctgctcctgggcctgatgatcctcctgaccgggggcgccatgctgttcctcatcagcggcaaggggatcggcaagacctccatcgggctgatctgcgtggtcgccagctccggcatgctgtggatggccgacgtgccgctccagtggatcgccagcgcgatcgtgctggagttcttcatgatggtcctgctcatccccgagcccgagaagcagcggacgccccaggacaaccagctggcctacgtggtgatcgggatcctgaccctcgccgccatcgtcgccgcgaacgagatgggcctgctggagaccaccaagcgcgacctcggcatgtccaaggagccgggggtggtgagccccacgtcctacctggacgtcgacctgcaccccgccagcgcctggaccctctacgccgtggcgaccaccgtgatcacgcccatgctgcggcacaccatcgagaactccaccgccaacgtcagcctggccgccatcgccaaccaggcggtggtgctcatgggcctggacaaggggtggccgatctccaagatggacctgggcgtccccctcctggccctggggtgctacagccaggtgaaccccctcaccctgacggccgccgtgctgctcctggtcacccactacgccatcatcggccccggcctgcaggcgaaggccacccgcgaggcccagaagcggaccgccgccgggatcatgaagaacccgacggtggacggcatcatgaccatcgacctcgaccccgtgatctacgactccaagttcgagaagcagctggggcaggtcatgctgctcgtgctgtgcgcggtgcagctgctcctgatgcgcaccagctgggccttctgcgaggccctgaccctcgccacgggccccatcaccaccctgtgggagggctcccccgggaagttctggaacaccacgatcgcggtcagcatggccaacatcttccggggctcctacctggccggggccggcctcgccttcagcatcatgaagtccgtggggaccggcaagcgcggcaccgggagccagggcgagaccctgggggagaagtggaagaagaagctgaaccagctcagccggaaggagttcgacctgtacaagaagtccggcatcacggaggtggaccgcaccgaggcgaaggaggggctgaagcggggcgagatcacccaccacgccgtcagccgcggctccgccaagctccagtggttcgtggagcggaacatggtgatcccggaggggcgcgtcatcgacctgggctgcgggcggggcgggtggagctactactgcgccggcctgaagaaggtgaccgaggtgcgcggctacaccaagggcgggcccgggcacgaggagcccgtccccatgtccacgtacggctggaacatcgtgaagctcatgagcgggaaggacgtgttctacctgccgcccgagaagtgcgacaccctgctgtgcgacatcggcgagtccagcccctcccccaccgtcgaggagagccgcaccatccgggtgctcaagatggtggagccgtggctgaagaacaaccagttctgcatcaaggtcctgaacccctacatgcccacggtgatcgagcacctcgagcgcctgcagcggaagcacggcgggatgctggtgcgcaaccccctctcccggaacagcacccacgagatgtactggatctccaacggcaccgggaacatcgtcagctccgtgaacatggtgagccgcctgctgctcaaccggttcaccatgacgcaccgccggccgaccatcgagaaggacgtcgacctgggcgccggcacccgccacgtgaacgcggagcccgagacccccaacatggacgtcatcggggagcggatccgccggatcaaggaggagcactccagcacgtggcactacgacgacgagaacccgtacaagacctgggcctaccacggctcctacgaggtgaaggccaccgggagcgccagctccatgatcaacggcgtggtcaagctgctcaccaagccctgggacgtggtgcccacggtcacccagatggccatgaccgacaccacgcccttcgggcagcagcgcgtgttcaaggagaaggtggacacccggaccccgcgccccatgcccggcacccggaaggtcatggagatcacggcggagtggctgtggcgcaccctgggccggaacaagcgcccccgcctctgcacccgggaggagttcaccaagaaggtgcgcacgaacgccgccatgggggccgtgttcaccgaggagaaccagtgggacagcgcgcgggccgccgtcgaggacgaggagttctggaagctggtggaccgcgagcgggagctgcacaagctcggcaagtgcgggtcctgcgtgtacaacatgatgggcaagcgcgagaagaagctgggggagttcggcaaggccaagggcagccgggccatctggtacatgtggctgggggcgcgctacctcgagttcgaggccctgggcttcctgaacgaggaccactggttctcccgggagaacagctactccggggtcgagggcgaggggctccacaagctgggctacatcctgcgcgacatcagcaagatcccgggcggggccatgtacgccgacgacaccgccggctgggacacccggatcacggaggacgacctccacaacgaggagaagatcacccagcagatggaccccgagcaccgccagctggcgaacgccatcttcaagctgacctaccagaacaaggtggtgaaggtccagcggcccacccccaaggggacggtgatggacatcatctcccgcaaggaccagcggggcagcggccaggtggggacctacggcctcaacaccttcaccaacatggaggcccagctgatccgccagatggagggggagggcgtcctgtccaaggccgacctcgagaacccgcacctcctggagaagaagatcacccagtggctcgagacgaagggggtggagcggctgaagcgcatggccatcagcggcgacgactgcgtggtcaagcccatcgacgaccggttcgcgaacgccctgctcgccctgaacgacatgggcaaggtgcgcaaggacatcccccagtggcagccctccaaggggtggcacgactggcagcaggtcccgttctgcagccaccacttccacgagctgatcatgaaggacggccggaagctcgtcgtgccctgccgcccccaggacgagctgatcgggcgcgcccggatctcccagggcgccgggtggagcctgaaggagaccgcgtgcctcggcaaggcctacgcccagatgtgggccctgatgtacttccaccgccgggacctgcgcctcgcgtccaacgccatctgcagcgccgtgcccgtccactgggtgccgacctcccggaccacgtggagcatccacgcccaccaccagtggatgaccaccgaggacatgctgaccgtgtggaaccgcgtctggatcgaggacaacccctggatggaggacaagacgcccgtgaccacctgggaggacgtgccctacctgggcaagcgggaggaccagtggtgcgggagcctcatcggcctgacctcccgcgccacgtgggcgcagaacatcctgaccgccatccagcaggtccggagcctcatcgggaacgaggagttcctggactacatgccgtccatgaagcgcttccggaaggaggaggagagcgagggcgccatctggtga

SEQ ID NO: 10396 - RNA, 9873 nt, synthetic construct
  misc_feature 1..9873: note = derived and/or modified CDS sequence (opt1) from DENV-3__AY858039__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtcgccctggcgccccacgtgggcatggggctggacacccgcgcgcagacctggatgagcgccgagggcgcctggcggcaggtcgagaaggtcgagacgtgggccttccgccaccccgggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacgtgaccaccgacagccgctgccccacgcagggcgaggccatcctgccggaggagcaggaccagaactacgtctgcaagcacacctacgtggaccgggggtggggcaacgggtgcggcctcttcgggaagggctccctggtgacctgcgccaagttccagtgcctggagctcatcgagggcaaggtcgtgcagcacgagaacctgaagtacaccgtgatcatcacggtccacaccggggaccagcaccaggtgggcaacgagacccagggggtcaccgccgagatcacgccccaggccagcaccgtggaggcgatcctgcccgagtacggcaccctcgggctggagtgcagcccccggaccggcctggacttcaacgagatgatcctcctgaccatgaagaacaaggcctggatggtgcaccggcagtggttcttcgacctgccgctcccctggacgagcggcgccaccaccgagacccccacgtggaacaagaaggagctgctggtcaccttcaagaacgcccacgccaagaagcaggaggtggtggtcctcgggtcccaggagggcgcgatgcacaccgccctgaccggggccacggagatccagaccagcggcgggacctccatcttcgccggccacctgaagtgccgcctcaagatggacaagctggagctgaagggcatgagctacgccatgtgctccaacgcgttcgtgctcaagaaggaggtgagcgagacccagcacgggacgatcctgatcaaggtcgagtacaagggcgaggacgccccctgcaagatcccgttcagcaccgaggacgggcagggcaaggcccacaacggccggctgatcaccgccaaccccgtggtgaccaagaaggaggagcccgtcaacatcgaggcggagcccccgttcggggagtccaacatcatcatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtgggcggggtgctgaactccctgggcaagatggtccaccagatcttcgggagcgcctacaccgccctcttctccggcgtgagctggatcatgaagatcggcatcggggtgctgctgacctggatcggcctcaactccaagaacacgagcatgtccttcagctgcatcgtcatcgggatcatcaccctgtacctgggcgccgtggtgcaggcggacatggggtgcgtcatcaactggaagggcaaggagctcaagtgcggctccgggatcttcgtgaccaacgaggtgcacacctggacggagcagtacaagttccaggccgacagccccaagcggctggccaccgccatcgccggcgcgtgggagaacggggtctgcggcatccgctccaccacccgcatggagaacctgctctggaagcagatcgccaacgagctgaactacatcctgtgggagaacaacatcaagctcacggtggtggtcggggacatcatcggcgtgctggagcagggcaagcggaccctgacgccccagcccatggagctcaagtacagctggaagacctgggggaaggccaagatcgtgacggccgagatccagaactccagcttcatcatcgacggcccgaacacccccgagtgccccaacgcgtcccgcgcctggaacgtctgggaggtggaggactacgggttcggcgtgttcaccaccaacatctggctgaagctgcgggagatgtacacgcagctctgcgaccaccgcctgatgagcgccgccgtcaaggacgagcgggccgtgcacgcggacatgggctactggatcgagagccagaagaacgggtcctggaagctggagaaggccagcctcatcgaggtgaagacctgcacctggcccaagtcccacaccctgtggagcaacggcgtcctggagtccgacatgatcatccccaagtccctcgccgggcccatctcccagcacaactaccgccccggctaccacacccagacggccgggccgtggcacctgggcaagctggagctcgacttcaactactgcgagggcaccaccgtggtgatcaccgagaactgcgggacgcggggccccagcctgcgcaccaccaccgtctccgggaagctgatccacgagtggtgctgccggagctgcacgctgccgcccctccgctacatgggcgaggacgggtgctggtacggcatggagatccggccgatcaacgagaaggaggagaacatggtgaagtccctggtgagcgccggctccgggaaggtcgacaacttcaccatgggcgtgctctgcctggcgatcctgttcgaggaggtgatgcgcgggaagttcggcaagaagcacatgatcgccggggtcctcttcatcttcgtgctgctgctcagcggccagatcacctggcgggacatggcccgcaccctgatcatgatcggctccaacgccagcgaccggatggggatgggcgtgacgtacctggccctcatcgcgaccttcaagatccagcccttcctggccctggggttcttcctccgcaagctgacctcccgggagaacctgctcctgggcgtcggcctggccatggccaccacgctccagctgcccgaggacatcgagcagatggcgaacgggatcgccctgggcctcatggccctgaagctgatcacccagttcgagacctaccagctctggaccgccctggtgagcctgacgtgcagcaacaccatcttcaccctcaccgtggcctggcgcacggcgaccctgatcctggccgggatctccctcctgcccgtctgccagagctccagcatgcggaagaccgactggctgccgatgaccgtggccgccatgggcgtgccgcccagccccctcttcatcttcagcctgaaggacacgctgaagcgccgctcctggccgctcaacgagggggtgatggccgtgggcctggtcagcatcctggcgtccagcctcctgcggaacgacgtgcccatggccggccccctggtggccgggggcctcctgatcgcctgctacgtcatcaccgggacctccgccgacctgaccgtggagaaggcggccgacgtgacgtgggaggaggaggccgagcagaccggcgtcagccacaacctcatgatcaccgtggacgacgacgggaccatgcgcatcaaggacgacgagacggagaacatcctgaccgtgctgctcaagaccgccctgctgatcgtctccggcatcttcccctacagcatcccggccaccctcctggtgtggcacacctggcagaagcagacgcagcggtccggcgtgctgtgggacgtcccctccccgcccgagacccagaaggcggagctcgaggagggggtgtaccgcatcaagcagcggggcatcttcgggaagacccaggtgggcgtcggggtgcagaaggagggcgtgttccacaccatgtggcacgtcacgcgcggcgccgtgctgacctacaacgggaagcggctggagccgaactgggcctccgtgaagaaggacctcatcagctacggcgggggctggcgcctgtccgcccagtggcagaagggggaggaggtccaggtgatcgcggtggagcccggcaagaaccccaagaacttccagaccatgcccggcatcttccagaccacgaccggggagatcggcgccatcgccctggacttcaagccggggaccagcggcagccccatcatcaaccgggagggcaaggtcgtggggctgtacggcaacggggtggtcaccaagaacggcgggtacgtgtccggcatcgcccagacgaacgccgagcccgacggcccgacccccgagctcgaggaggagatgttcaagaagcgcaacctgaccatcatggacctgcaccccgggagcggcaagacccggaagtacctccccgcgatcgtgcgcgaggccatcaagcggcgcctgcggacgctgatcctcgccccgacccgcgtcgtggccgccgagatggaggaggcgctgaaggggctgcccatccggtaccagaccaccgccacgaagtccgagcacaccggcaaggagatcgtggacctcatgtgccacgccaccttcaccatgcgcctgctgagccccgtccgggtgcccaactacaacctcatcatcatggacgaggcccacttcacggacccggcctccatcgcggcccgcgggtacatcagcacccgggtgggcatgggcgaggccgccgcgatcttcatgaccgccacgccgcccgggacggccgacgccttcccccagtccaacgccccgatccaggacgaggagcgcgacatccccgagcgcagctggaactccggcaacgactggatcaccgacttcgcggggaagaccgtctggttcgtgcccagcatcaaggccggcaacgacatcgccaactgcctgcggaagaacgggaagaaggtgatccagctgtcccgcaagaccttcgacacggagtaccagaagaccaagctcaacgactgggacttcgtcgtgaccaccgacatcagcgagatgggcgccaacttcaaggccgaccgggtgatcgacccccgccggtgcctgaagccggtcatcctgacggacggccccgagcgcgtgatcctcgcggggcccatgcccgtgaccgtcgcctccgccgcccagcggcgcggccgggtggggcgcaacccgcagaaggagaacgaccagtacatcttcaccggccagcccctgaacaacgacgaggaccacgcccactggaccgaggcgaagatgctgctcgacaacatcaacacgcccgaggggatcatccccgccctgttcgagccggagcgggagaagtccgccgccatcgacggcgagtaccgcctgaagggcgagtcccggaagaccttcgtggagctcatgcgccgcggggacctgcccgtctggctggcgcacaaggtggccagcgagggcatcaagtacaccgaccgcaagtggtgcttcgacggggagcggaacaaccagatcctcgaggagaacatggacgtcgagatctggaccaaggagggcgagaagaagaagctgcgcccccggtggctggacgcccgcacctactccgaccccctcgccctgaaggagttcaaggacttcgccgcgggccgcaagagcatcgccctggacctcgtgacggagatcgggcgggtgccgtcccacctggcccaccgcacccggaacgccctggacaacctcgtcatgctgcacaccagcgagcacggcgggcgcgcctaccggcacgcggtggaggagctgcccgagaccatggagacgctcctgctgctcggcctgatgatcctgctcaccgggggcgccatgctgttcctgatcagcggcaagggggtgggcaagacctccatcgggctcatctgcgtcgtggccagctccggcatgctgtggatggccgacatccccctgcagtggatcgccagcgcgatcgtgctcgagttcttcatgatggtcctgctgatcccggagcccgagaagcagcgcacgccccaggacaaccagctcgcctacgtggtgatcgggatcctgacgctggccgccatcgtcgccgcgaacgagatgggcctcctggagaccaccaagcgggacctgggcatgtccaaggagcccggggtggtgagcccgacctcctacctcgacgtcgacctgcaccccgccagcgcctggacgctgtacgccgtggcgaccaccgtgatcacccccatgctccgccacacgatcgagaactccaccgccaacgtcagcctggccgccatcgccaaccaggcggtggtgctgatgggcctcgacaaggggtggcccatctccaagatggacctgggcgtcccgctgctcgccctggggtgctacagccaggtgaaccccctgaccctcaccgccgccgtgctgctgctcgtcacgcactacgccatcatcggccccggcctgcaggcgaaggccacccgggaggcccagaagcgcaccgccgccgggatcatgaagaaccccaccgtggacggcatcatgacgatcgacctggacccggtgatctacgactccaagttcgagaagcagctcgggcaggtcatgctgctggtgctctgcgcggtgcagctgctgctcatgcggaccagctgggccttctgcgaggccctgaccctggccaccggccccatcacgaccctctgggagggctcccccgggaagttctggaacaccaccatcgcggtcagcatggccaacatcttccgcggctcctacctggccggggccggcctggccttcagcatcatgaagtccgtggggacgggcaagcggggcaccgggagccagggcgagaccctcggggagaagtggaagaagaagctgaaccagctgagccgcaaggagttcgacctctacaagaagtccggcatcaccgaggtggaccggacggaggcgaaggaggggctgaagcgcggcgagatcacccaccacgccgtcagccggggctccgccaagctgcagtggttcgtggagcgcaacatggtgatccccgaggggcgggtcatcgacctcggctgcgggcgcggcgggtggagctactactgcgccggcctgaagaaggtgaccgaggtgcggggctacaccaagggcgggccggggcacgaggagcccgtccccatgtccacctacggctggaacatcgtgaagctgatgagcgggaaggacgtgttctacctcccgcccgagaagtgcgacacgctgctgtgcgacatcggcgagtccagcccctcccccaccgtcgaggagagccgcaccatccgcgtgctgaagatggtggagccctggctcaagaacaaccagttctgcatcaaggtcctgaacccctacatgcccaccgtgatcgagcacctggagcggctccagcgcaagcacggcgggatgctggtgcggaaccccctgtcccgcaacagcacgcacgagatgtactggatctccaacggcaccgggaacatcgtcagctccgtgaacatggtgagccggctcctgctgaaccgcttcaccatgacctaccggcgccccacgatcgagaaggacgtcgacctcggcgccggcacccggcacgtgaacgcggagccggagacccccaacatggacgtcatcggggagcgcatccggcgcatcaaggaggagcactccagcacctggcactacgacgacgagaacccctacaagacgtgggcctaccacggctcctacgaggtgaaggccaccgggagcgccagctccatgatcaacggcgtggtcaagctgctgaccaagccgtgggacgtggtgcccaccgtcacgcagatggccatgaccgacaccacccccttcgggcagcagcgggtgttcaaggagaaggtggacacgcgcacccccaagccgatgcccggcacccggaaggtcatggagatcaccgcggagtggctctggcgcacgctgggccggaacaagcgcccccggctgtgcacccgcgaggagttcaccaagaaggtgcgcaccaacgccgccatgggggccgtgttcacggaggagaaccagtgggacagcgcgcgggccgccgtcgaggacgaggagttctggaagctcgtggaccgcgagcgggagctgcacaagctgggcaagtgcgggtcctgcgtgtacaacatgatgggcaagcgcgagaagaagctcggggagttcggcaaggccaagggcagccgggccatctggtacatgtggctgggggcgcgctacctggagttcgaggccctcggcttcctgaacgaggaccactggttctcccgggagaacagctactccggggtcgagggcgaggggctgcacaagctcggctacatcctgcgcgacatcagcaagatccccggcggggccatgtacgccgacgacaccgccggctgggacacccggatcaccgaggacgacctgcacaacgaggagaagatcacgcagcagatggacccggagcaccgccagctcgcgaacgccatcttcaagctgacctaccagaacaaggtggtgaaggtccagcggcccacccccaaggggaccgtgatggacatcatctcccgcaaggaccagcggggcagcggccaggtggggacgtacggcctgaacaccttcaccaacatggaggcccagctcatccgccagatggagggggagggcgtcctgtccaagaccgacctggagaacccccacctcctggagaagaagatcacccagtggctggagacgaagggggtggagcggctcaagcgcatggccatcagcggcgacgactgcgtggtcaagccgatcgacgaccggttcgccaacgcgctgctggccctcaacgacatgggcaaggtgcgcaaggacatcccccagtggcagccctccaaggggtggcacgactggcagcaggtccccttctgcagccaccacttccacgagctgatcatgaaggacggccggaagctggtcgtgccgtgccgcccccaggacgagctcatcgggcgggcccgcatctcccagggcgccgggtggagcctgaaggagaccgcctgcctgggcaaggcgtacgcccagatgtgggccctcatgtacttccaccgccgggacctgcgcctggcctccaacgcgatctgcagcgccgtgcccgtccactgggtgcccacctcccggaccacgtggagcatccacgcccaccaccagtggatgaccaccgaggacatgctcaccgtgtggaaccgcgtctggatcgaggacaacccgtggatggaggacaagacgcccgtgaccacctgggaggacgtgccctacctgggcaagcgggaggaccagtggtgcgggagcctgatcggcctcacctcccgcgccacgtgggcccagaacatcctgaccgcgatccagcaggtccggagcctgatcgggaacgaggagttcctcgactacatgccctccatgaagcgcttccggaaggaggaggagagcgagggcgccatctggtga

SEQ ID NO: 10397 - RNA, 9873 nt, synthetic construct
  misc_feature 1..9873: note = derived and/or modified CDS sequence (opt1) from DENV-3__JN368477__SS-prME
  source 1..9873: mol_type = other RNA
accagcctgtgcctcatgatgatgctgcccgcgaccctggccttccacctcaccagccgggacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacctacaagtgccccctgatcgccgaggtggagcccgaggacatcgactgctggtgcaacctcaccagcacctgggtgacctacgggacgtgcaaccaggccggcgagcaccggcgcgacaagcggtccgtcgccctggcgccccacgtgggcatggggctggacacccgcacccagacctggatgagcgccgagggcgcctggcgccaggtggagaaggtcgagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagagcaagcccaccctggacatcgagctgcagaagaccgaggccacccagctcgcgacgctgcggaagctgtgcatcgagggcaagatcaccaacatcaccaccgactcccgctgccccacgcagggcgaggccaccctcccggaggagcaggaccagaactacgtgtgcaagcacacctacgtcgaccgggggtggggcaacgggtgcggcctgttcgggaagggcagcctggtgacctgcgccaagttccagtgcctcgagcccatcgagggcaaggtggtccagtacgagaacctgaagtacacggtgatcatcaccgtgcacaccggggaccagcaccaggtcggcaacgacacccagggggtgacggtcgagatcacgccccaggcctccaccgtggaggccgtgctgcccgagtacggcaccctcgggctggagtgcagcccgcgcaccggcctggacttcaacgagatgatcctcctgacgatgaagaacaaggcgtggatggtccaccggcagtggttcttcgacctgcccctcccctggacctccggcgccaccaccgagacgcccacctggaaccgcaaggagctgctggtgaccttcaagaacgcccacgccaagaagcaggaggtggtcgtgctcgggagccaggagggcgccatgcacaccgcgctgacgggggccaccgagatccagaactccggcgggaccagcatcttcgccggccacctgaagtgccggctcaagatggacaagctggagctgaagggcatgtcctacgccatgtgcctcaacaccttcgtgctgaagaaggaggtcagcgagacgcagcacgggaccatcctgatcaaggtggagtacaagggcgaggacgccccgtgcaagatccccttcagcaccgaggacgggcagggcaaggcgcacaacggccgcctgatcaccgccaaccccgtggtcacgaagaaggaggagcccgtgaacatcgaggccgagccgcccttcggggagtccaacatcgtgatcggcatcggggacaaggccctcaagatcaactggtacaagaagggcagctccatcgggaagatgttcgaggcgaccgcccggggcgcccgccggatggccatcctgggcgacaccgcctgggacttcgggagcgtcggcggggtgctgaactccctcggcaagatggtgcaccagatcttcgggagcgcgtacaccgccctgttctccggcgtcagctggatcatgaagatcggcatcggggtgctgctcacgtggatcggcctgaactccaagaacaccagcatgtccttcagctgcatcgtgatcgggatcatcaccctgtacctcggcgccgtcgtgcaggccgacatggggtgcgtgatcaactggaagggcaaggagctgaagtgcggcaacgggatcttcgtcaccaacgaggtgcacacgtggaccgagcagtacaagttccaggccgactcccccaagcgcctggcgaccgccatcgccggcgcctgggagaacggggtgtgcggcatccgcagcaccacgcggatggagaacctcctgtggaagcagatcgccaacgagctgaactacatcctctgggagaacaacatcaagctgaccgtcgtggtgggggacatcatcggcgtcctggagcagggcaagcgcaccctcacgccccagccgatggagctgaagtactcctggaagacgtgggggaaggcgaagatcgtgaccgccgagacccagaacagctccttcatcatcgacggccccaacacccccgagtgccccagcgcctcccgggcctggaacgtgtgggaggtcgaggactacgggttcggcgtgttcacgaccaacatctggctgaagctccgcgaggtgtacacccagagctgcgaccaccggctgatgagcgcggccatcaaggacgagcgcgccgtccacgccgacatgggctactggatcgagtcccagaagaacgggagctggaagctggagaaggcctccttcatcgaggtgaagacctgcacctggcccaagagccacacgctctggtccaacggcgtgctggagagcgacatgatcatccccaagtccctggcggggcccatcagccagcacaaccaccggccgggctaccacacccagaccgccgggccctggcacctcggcaagctggagctggacttcaactactgcgagggcaccacggtcgtgatcgccgagaactgcgggacccgcggcccctccctccggaccaccacggtgagcgggaagctgatccacgagtggtgctgccgctcctgcaccctgcccccgctccggtacatgggcgaggacgggtgctggtacggcatggagatccgccccatcaacgagaaggaggagaacatggtcaagagcctggtgtccgccggcagcgggaaggtggacaacttcaccatgggcgtcctgtgcctcgccatcctgttcgaggaggtgatgcgggggaagttcggcaagaagcacatgatcgcgggggtgctgttcaccttcgtcctcctgctgtccggccagatcacgtggcgcgacatggcccacaccctcatcatgatcggcagcaacgcctccgaccggatggggatgggcgtgacccacctggccctgatcgccaccttcaagatccagcccttcctcgcgctggggttcttcctgcgcaagctcacgagccgggagaacctgctgctcggcgtgggcctggccatggccaccaccctgcagctccccgaggacatcgagcagatggccaacgggatcgcgctgggcctgatgaccctcaagctgatcacgcagttcgagacctaccagctgtggaccgccctcgtcagcctgacctgctccaacacgatcttcaccctgaccgtggcctggcgcaccgccacgctcatcctggccggggtcagcctgctcccgctgtgccagtccagctccatgcggaagaccgactggctgcccatgaccgtggcggccatgggcgtgccgcccctgccgctgttcatcttcagcctgaaggacacccccaagcgccgctcctggcccctcaacgagggggtcatggccgtgggcctggtgagcatcctggcctccagcctcctgcggaacgacgtccccatggccggcccgctggtggccggcgggctcctgatcgcctgctacgtgatcacggggacctccgccgacctgaccgtcgagaaggccgccgacgtgacctgggaggaggaggcggagcagacgggggtgagccacaacctcatgatcaccgtcgacgacgacgggaccatgcgcatcaaggacgacgagaccgagaacatcctgaccgtgctgctcaagacggccctgctgatcgtgtccggcatcttcccctacagcatccccgccaccctcctggtctggcacacctggcagaagcagacccagcggtccggcgtgctgtgggacgtgcccagcccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggcgtccgtgaagaaggacctcatcagctacggcgggggctggcggctgtccgcccagtggcagaagggggaggaggtgcaggtcatcgccgtggagcccggcaagaacccgaagaacttccagaccatgcccggcatcttccagaccaccacgggggagatcggcgccatcgcgctggacttcaagcccgggaccagcggcagcccgatcatcaaccgcgagggcaaggtggtcgggctgtacggcaacggggtggtgaccaagaacggcgggtacgtctccggcatcgcccagaccaacgccgagcccgacggccccacgcccgagctcgaggaggagatgttcaagaagcggaacctgaccatcatggacctgcacccggggagcggcaagacccgcaagtacctccccgccatcgtgcgggaggccatcaagcgccggctgcgcaccctgatcctcgcgcccacgcgggtggtcgccgccgagatggaggaggccctgaaggggctgcccatccgctaccagaccaccgccaccaagtccgagcacacgggccgggagatcgtggacctcatgtgccacgcgaccttcaccatgcgcctgctgagcccggtgcgggtccccaactacaacctcgtgatcatggacgaggcccacttcaccgaccccgcctccatcgccgcccgcgggtacatcagcacgcgggtgggcatgggcgaggcggccgccatcttcatgaccgccacgccgcccgggaccgcggaggccttcccccagtccaacgcccccatccaggacgaggagcgcgacatccccgagcgcagctggaactccggcaacgagtggatcacggacttcgtcgggaagaccgtgtggttcgtgcccagcatcaaggccggcaacgacatcgccaactgcctgcggaagaacgggaagaaggtcatccagctgtcccgcaagaccttcgacaccgagtaccagaagacgcggctcaacgactgggacttcgtggtgaccaccgacatcagcgagatgggcgcgaacttcaaggccgaccgcgtcatcgacccccggcgctgcctgaagcccgtgatcctgaccgacggccccgagcgggtgatcctcgccgggccgatgcccgtcacggccgcctccgcggcccagcgccggggccgcgtggggcggaacccccagaaggagaacgaccagtacatcttcaccggccagcccctgaacaacgacgaggaccacgcccactggaccgaggccaagatgctgctcgacaacatcaacaccccggaggggatcatccccgccctgttcgagcccgagcgcgagaagtccgcggccatcgacggcgagtaccggctgaagggcgagtcccgcaagaccttcgtcgagctcatgcggcgcggggacctgcccgtgtggctggcccacaaggtggccagcgagggcatcaagtacacggaccggaagtggtgcttcgacggggagcgcaacaaccagatcctcgaggagaacatggacgtcgagatctggaccaaggagggcgagcggaagaagctgcgcccgcgctggctggacgcgcggacctactccgaccccctcgccctgaaggagttcaaggacttcgccgccggccgcaagagcatcgccctggacctcgtgaccgagatcgggcgggtgccctcccacctggcgcaccgcacgcggaacgccctggacaacctcgtcatgctgcacaccagcgagcacggcgggcgcgcctaccggcacgccgtggaggagctgccggagaccatggagaccctcctgctgctcggcctgatgatcctgctcaccggcggggccatgctgttcctgatcagcgggaaggggatcggcaagacctccatcgggctcatctgcgtgatcgtcagctccggcatgctgtggatggcggacgtgcccctgcagtggatcgccagcgccatcgtgctcgagttcttcatgatggtcctgctgatccccgagcccgagaagcagcgcaccccgcaggacaaccagctcgcctacgtggtgatcgggatcctgaccctggccgcgatcgtcgccgccaacgagatgggcctcctggagacgaccaagcgggacctgggcatgtccaaggagcccggggtggtgagccccacctcctacctcgacgtcgacctgcaccccgccagcgcctggaccctgtacgcggtggccacgaccgtgatcaccccgatgctccgccacaccatcgagaactccacggccaacgtcagcctggccgcgatcgccaaccaggccgtggtgctgatgggcctcgacaaggggtggcccatctccaagatggacctgggcgtccccctgctcgccctggggtgctacagccaggtgaaccccctgaccctcaccgccgcggtgctgctgctcgtcacccactacgccatcatcggcccgggcctgcaggccaaggccacgcgggaggcccagaagcgcaccgcggccgggatcatgaagaaccccaccgtggacggcatcatgaccatcgacctggaccccgtgatctacgactccaagttcgagaagcagctcgggcaggtcatgctgctggtgctctgcgccgtgcagctgctgctcatgcggacgagctgggccctgtgcgaggccctgaccctcgcgaccggccccatcaccacgctgtgggagggctccccggggaagttctggaacaccaccatcgccgtcagcatggccaacatcttccgcggctcctacctggccggggcgggcctcgccttcagcatcatgaagtccgtggggaccggccggcgcggcacggggagccagggcgagaccctgggggagaagtggaagaagaagctgaaccagctcagccggaaggagttcgacctgtacaagaagtccggcatcaccgaggtggaccgcaccgaggccaaggaggggctgaagcggggcgagaccacgcaccacgccgtcagccgcggctccgccaagctccagtggttcgtggagcggaacatggtgatccccgaggggcgcgtcatcgacctgggctgcgggcgcggcgggtggagctactactgcgcgggcctgaagaaggtgaccgaggtgcggggctacaccaagggcggccccgggcacgaggagcccgtcccgatgtccacctacggctggaacatcgtgaagctcatgagcgggaaggacgtgttctacctgccgcccgagaagtgcgacacgctgctgtgcgacatcggcgagtccagcccctccccgaccgtcgaggagagccgcaccatccgggtgctcaagatggtggagccctggctgcgcaacaaccagttctgcatcaaggtcctgaacccctacatgcccaccgtgatcgagcacctcgagcggctgcagcgcaagtacggcgggatgctggtgcggaacccgctctcccgcaacagcacgcacgagatgtactggatctccaacggcaccgggaacatcgtcagctccgtgaacatggtcagccggctgctgctcaaccgcttcaccatgacccaccggcgccccacgatcgagaaggacgtggacctgggcgccggcacccggcacgtgaacgccgagcccgagaccccgaacatggacgtcatcggggagcgcatcaagcggatcaaggaggagcactccagcacctggcactacgacgacgagaacccctacaagacgtgggcctaccacggctcctacgaggtgaaggccaccgggagcgcgagctccatgatcaacggcgtggtcaagctgctcaccaagccctgggacgtggtgcccatggtcacccagatggccatgacggacaccaccccgttcgggcagcagcgcgtgttcaaggagaaggtggacacccggacgccccgccccatgcccggcacccggaaggtcatggagatcaccgccgagtggctgtggcgcaccctgggccgcaacaagaagccgcggctctgcacgcgcgaggagttcaccaagaaggtgcggaccaacgccgccatgggggcggtgttcaccgaggagaaccagtgggacagcgcccgcgccgccgtcgaggacgaggagttctggaagctggtggacaaggagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtcgagggcgaggggctccacaagctgggctacatcctgcgcgacatcagcaagatccccggcggggccatgtacgcggacgacacggccggctgggacacccggatcaccgaggacgacctccacaacgaggagaagatcacccagcagatggaccccgggcaccgccagctggccaacgccatcttcaagctgacgtaccagaacaaggtggtgaaggtccagcggcccaccccgaagggcaccgtgatggacatcatctcccgcaaggaccagcggggcagcggccaggtgggcacctacgggctcaacaccttcacgaacatggaggcccagctggtccgccagatggagggcgagggggtgctgtccaaggcggacctcgagaacccccacctcctggagaagaagatcacccagtggctcgagaccaagggcgtggagcggctgaagcgcatggccatcagcggcgacgactgcgtcgtgaagcccatcgacgaccggttcgccaacgccctgctcgccctgaacgacatggggaaggtgcgcaaggacatcccccagtggcagccgtccaagggctggcacgactggcagcaggtccccttctgcagccaccacttccacgagctgatcatgaaggacgggcggaagctcgtggtgccctgccgcccccaggacgagctgatcggccgcgcgcggatctcccagggggccggctggagcctgaaggagaccgcctgcctcggcaaggcctacgcccagatgtggtccctgatgtacttccaccgccgggacctgcgcctcgcgagcaacgccatctgctccgccgtcccggtgcactggatccccacgagccggaccacctggagcatccacgcccaccaccagtggatgaccacggaggacatgctgaccgtgtggaaccgcgtctggatcgaggacaacccctggatggaggacaagacccccgtgaccacgtgggaggacgtgccgtacctggggaagcgggaggaccagtggtgcggctccctcatcgggctgaccagccgcgcgacctgggcccagaacatcctgaccgccatccagcaggtccggtccctcatcggcgacgaggagttcctggactacatgcccagcatgaagcgcttccggaaggaggaggagacggagggggccatctggtga

SEQ ID NO: 10398 - RNA, 9873 nt, synthetic construct
  misc_feature 1..9873: note = derived and/or modified CDS sequence (opt1) from DENV-3__EF643017__SS-prME
  source 1..9873: mol_type = other RNA
accagcctgtgcctcatgatgatcctgcccgccgccctggcgttccacctcaccagccgggacggggagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcggcgccgggacaagcgcagcgtggccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccgtgctgccggaggagcaggaccagaactacgtctgcaagcacacctacgtggaccgcgggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtgcaccgccagtggttcttcgacctgcccctgccctggaccagcggcgccaccaccgagacgcccacctggaaccggaaggagctcctggtgaccttcaagaacgcccacgccaagaagcaggaggtcgtggtgctggggtcccaggagggcgcgatgcacaccgccctcacgggggccaccgagatccagaacagcggcgggacctccatcttcagcggccacctgaagtgccgcctgaagatggacaagctcgagctgaagggcatgtcctacgccatgtgcaccaacacgttcgtcctgaagaaggaggtgagcgagacccagcacgggaccatcctcatcaaggtggagtaccggggcgaggacgccccgtgcaagatccccttcagcaccgaggacgggcagggcaaggcgcacaacggccgcctgatcacggccaaccccgtcgtgaccaagaaggaggagcccgtgaacatcgaggccgagccgcccttcggggagtccaacatcgtcatcggcatcggggacaacgccctgaagatcaactggtacaagaagggcagctccatcgggaagatgttcgaggcgaccgcccggggcgcccgccgcatggccatcctgggcgacaccgcctgggacttcgggagcgtgggcggggtgctcaactccctgggcaagatggtccaccagatcttcgggagcgcgtacacggccctgttctccggcgtgagctgggtgatgaagatcggcatcggggtcctcctgacctggatcggcctgaactccaagaacaccagcatgtccttcagctgcatcgccatcgggatcatcaccctctacctgggcgccgtggtgcaggccgacatggggtgcgtcatcaactggaagggcaaggagctgaagtgcggctccgggatcttcgtgacgaacgaggtgcacacctggaccgagcagtacaagttccaggcggacagccccaagcggctcgccaccgccatcgccggcgcctgggagaacggggtctgcggcatccgctccacgacccggatggagaacctgctgtggaagcagatcgcgaacgagctcaactacatcctgtgggagaacaacatcaagctgaccgtggtggtcggggacatcatcggcgtgctcgagcagggcaagcgcaccctgacgccccagccgatggagctgaagtacagctggaagacctgggggaaggccaagatcgtgaccgccgagacccagaactccagcttcatcatcgacggccccaacacgcccgagtgcccctccgccagccgggcgtggaacgtctgggaggtggaggactacgggttcggcgtgttcaccaccaacatctggctcaagctgcgcgaggtctacacccagctgtgcgaccaccggctcatgagcgccgccgtgaaggacgagcgcgccgtgcacgccgacatgggctactggatcgagtcccagaagaacgggagctggaagctggagaaggcgtccctgatcgaggtcaagacctgcacgtggcccaagtcccacaccctctggtccaacggcgtgctggagagcgacatgatcacccccaagtccctggccgggcccatcagccagcacaaccaccggccgggctaccacacccagacggccgggccctggcacctcggcaagctggagctggacttcaactactgcgagggcaccaccgtggtcatcaccgagaactgcgggacgcgcggcccctccctccggaccaccaccgtgagcgggaagctgatccacgagtggtgctgccgctcctgcacgctgcccccgctccggtacatgggcgaggacgggtgctggtacggcatggagatccgccccatcagcgagaaggaggagaacatggtgaagtccctggtcagcgccggctccgggaaggtggacaacttcaccatgggcgtgctgtgcctcgccatcctgttcgaggaggtcatgcgggggaagttcggcaagaagcacatgatcgcgggggtgttcttcaccttcgtgctgctcctgagcggccagatcacctggcgcgacatgacgcacaccctgatcatgatcggctccaacgccagcgaccggatggggatgggcgtcacctacctcgccctgatcgccaccttcaagatccagcccttcctggccctcgggttcttcctgcgcaagctgacgagccgggagaacctcctgctgggcgtgggcctcgcgatggccaccaccctgcagctgcccgaggacatcgagcagatggccaacgggatcgccctcggcctgatggcgctgaagctcatcacccagttcgagacgtaccagctgtggaccgccctgatctccctgacctgcagcaacaccatgttcacgctgaccgtggcctggcgcaccgccaccctgatcctcgccggggtctccctgctgccggtgtgccagagctccagcatgcgcaagacggactggctccccatggcggtcgccgccatgggcgtgagccccctccccctgttcatcttcagcctcaaggacaccctgaagcggcgctcctggccgctgaacgagggggtgatggccgtcggcctcgtgagcatcctggcctccagcctgctccggaacgacgtgcccatggcgggccccctggtcgccgggggcctgctcatcgcctgctacgtgatcaccgggacctccgccgacctgacggtggagaaggccgcggacatcacccgcgaggaggaggccgagcagaccggcgtcagccacaacctgatgaccaccgtggacgacgacgggacgatgcggatcaaggacgacgagaccgagaacatcctcaccgtgctgctgaagaccgccctcctgatcgtctccggcgtgttcccctacagcatcccggccacgctgctcgtgtggcacacctggcagaagcagacccagcgctccggcgtcctgtgggacgtgccctccccgcccgagacccagaaggccgagctggaggagggggtgtaccggatcaagcagcagggcatcttcgggaagacgcaggtcggcgtgggggtgcagaaggagggcgtcttccacaccatgtggcacgtgacccgcggcgcggtgctcacctacaacgggaagcggctggagccgaactgggcctccgtcaagaaggacctgatcagctacggcgggggctggcgcctcagcgcccagtggcagaagggggaggaggtccaggtgatcgccgtcgagcccggcaagaaccccaagaacttccagacgatgcccggcaccttccagaccaccacgggggagatcggcgcgatcgccctggacttcaagccggggacctccggcagccccatcatcaaccgggagggcaaggtggtggggctgtacggcaacggggtcgtgaccaagaacggcgggtacgtgtccggcatcgcccagaccaacgccgagcccgacggcccgacgcccgagctggaggaggagatgttcaagaagcgcaacctcaccatcatggacctgcaccccgggagcggcaagacccggaagtacctgcccgccatcgtccgcgaggcgatcaagcggcgcctccggaccctgatcctggccccgacgcgcgtggtggccgccgagatggaggaggccctcaaggggctgcccatccggtaccagaccaccgcgaccaagtccgagcacacgggccgcgagatcgtcgacctgatgtgccacgccaccttcaccatgcggctcctgagccccgtgcgcgtgcccaactacaacctgatcatcatggacgaggcccacttcaccgacccggcctccatcgccgcgcgcgggtacatcagcacgcgggtcggcatgggcgaggccgccgccatcttcatgaccgcgacgccgcccgggaccgccgacgccttcccccagtccaacgccccgatccaggacgaggagcgcgacatccccgagcggagctggaactccggcaacgagtggatcacggacttcgccgggaagaccgtgtggttcgtgcccagcatcaaggcgggcaacgacatcgccaactgcctccgcaagaacgggaagaaggtcatccagctgtcccggaagaccttcgacaccgagtaccagaagacgaagctgaacgactgggacttcgtggtgaccaccgacatcagcgagatgggcgccaacttcaaggccgaccgcgtcatcgacccccggcgctgcctcaagccggtgatcctgaccgacggccccgagcgggtgatcctggccgggcccatgcccgtcaccgcggcctccgccgcccagcgccggggccgcgtggggcggaacccgcagaaggagaacgaccagtacatcttcacgggccagcccctcaacaacgacgaggaccacgcccactggaccgaggcgaagatgctgctggacaacatcaacacccccgaggggatcatccccgccctcttcgagccggagcgcgagaagtccgccgccatcgacggcgagtaccggctgaagggcgagtcccgcaagaccttcgtggagctgatgcggcgcggggacctccccgtctggctggcgcacaaggtggccagcgagggcatcaagtacacggaccggaagtggtgcttcgacgggcagcgcaacaaccagatcctggaggagaacatggacgtcgagatctggaccaaggagggcgagaagaagaagctccgcccccggtggctggacgcccgcacctactccgaccccctggccctcaaggagttcaaggacttcgccgcgggccgcaagagcatcgccctggacctggtgaccgagatcgggcgcgtgccgagccacctcgcccaccggacgcgcaacgccctggacaacctggtcatgctccacacctccgagcacggcgggcgggcctaccgccacgcggtggaggagctgcccgagaccatggagaccctgctcctgctgggcctcatgatcctgctgaccggcggggccatgctgttcctgatcagcgggaaggggatcggcaagacctccatcgggctgatctgcgtgatcgccagctccggcatgagctggatggccgagatccccctccagtggatcgcctccgcgatcgtcctggagttcttcatgatggtgctgctcatcccggagcccgagaagcagcggacgccccaggacaaccagctggcctacgtggtcatcgggatcctgaccctcgccgccatcatcgccgcgaacgagatgggcctgctggagacgaccaagcgcgacctcggcatgagcaaggagcccggggtggtgtccccgaccagctacctggacgtcgacctgcaccccgcctccgcctggaccctctacgccgtggcgacgaccgtgatcacccccatgctgcggcacaccatcgagaacagcacggccaacgtctccctggccgccatcgccaaccaggcggtggtgctcatgggcctggacaaggggtggcccatcagcaagatggacctgggcgtcccgctcctggccctggggtgctactcccaggtgaaccccctcaccctgaccgccgccgtgctgctcctgatcacccactacgccatcatcggccccggcctgcaggcgaaggccacgcgcgaggcccagaagcggaccgccgccgggatcatgaagaaccccaccgtcgacggcatcatgaccatcgacctcgacccggtgatctacgacagcaagttcgagaagcagctgggccaggtgatgctgctcgtcctgtgcgcggtgcagctgctcctgatgcgcacgtcctgggccctgtgcgaggccctcaccctggccaccggccccatcaccacgctgtgggagggcagccccgggaagttctggaacaccaccatcgcggtgtccatggccaacatcttccggggcagctacctcgccggggtcggcctggccttcagcatcatgaagtccgtggggaccggcaagcgcggcaccgggagccagggcgagacgctgggggagaagtggaagaagaagctcaaccagctgtcccggaaggagttcgacctgtacaagaagtccggcatcaccgaggtggaccgcaccgaggccaaggaggggctcaagcggggcgagatcacccaccacgcggtctcccgcggcagcgccaagctgcagtggttcgtggagcggaacatggtgatccccgaggggcgcgtcatcgacctgggctgcgggcgcggcgggtggtcctactactgcgccggcctcaagaaggtgacggaggtgcggggctacaccaagggcgggccggggcacgaggagcccgtccccatgagcacctacggctggaacatcgtgaagctgatgtccgggaaggacgtgttctacctgcccccggagaagtgcgacaccctcctgtgcgacatcggcgagagctcccccagccccacggtcgaggagtcccgcaccatccgggtgctgaagatggtggagccctggctgaagaacaaccagttctgcatcaaggtcctcaacccgtacatgcccaccgtgatcgagcacctggagcgcctgcagcggaagcacggcgggatgctcgtgcgcaaccccctgagccggaactccacccacgagatgtactggatcagcaacggcacggggaacatcgtcgcctccgtgaacatggtgagccgcctgctcctgaaccggttcaccatgacccaccgccggcccaccatcgagaaggacgtcgacctgggcgccggcacgcgccacgtgaacgcggagccggagacccccaacatggacgtgatcggggagcggatcaagcgcatcaaggaggagcacaactccacctggcactacgacgacgagaacccctacaagacctgggcctaccacggcagctacgaggtcaaggccacggggagcgcctccagcatgatcaacggcgtggtcaagctcctgaccaagccgtgggacgtggtgcccatggtcacccagatggccatgaccgacacgacccccttcgggcagcagcgggtgttcaaggagaaggtggacacccgcacgccccggtccatgccgggcacgcgccgggtcatgggcatcaccgcggagtggctgtggcgcaccctcgggcgcaacaagaagccccggctgtgcacccgcgaggagttcacgaagaaggtgcggaccaacgccgccatgggcgccgtgttcaccgaggagaaccagtgggacagcgcgaaggccgccgtcgaggacgaggacttctggaagctggtggaccgcgagcgggagctccacaagctggggaagtgcggctcctgcgtgtacaacatgatggggaagcgcgagaagaagctgggcgagttcggcaaggccaaggggagccgggccatctggtacatgtggctcggcgcgcgctacctggagttcgaggccctggggttcctcaacgaggaccactggttctcccgggagaacagctactccggcgtcgagggggagggcctgcacaagctgggctacatcctccgcgacatcagcaagatccccgggggcgccatgtacgccgacgacaccgccgggtgggacacgcggatcaccgaggacgacctgcacaacgaggagaagatcacccagcagatggaccccgagcaccgccagctggcgaacgccatcttcaagctcacctaccagaacaaggtggtgaaggtccagcggccgacccccacgggcaccgtgatggacatcatctcccgcaaggaccagcggggcagcggccaggtgggcacctacgggctgaacaccttcacgaacatggaggcccagctgatccgccagatggagggcgagggggtcctctccaaggccgacctggagaacccccacctccccgagaagaagatcacccagtggctcgagaccaagggcgtggagcggctgaagcgcatggccatcagcggcgacgactgcgtggtcaagccgatcgacgaccggttcgcgaacgccctgctcgccctgaacgacaccgggaaggtgcgcaaggacatcccccagtggcagccctccaagggctggcacgactggcagcaggtccccttctgcagccaccacttccacgagctgatcatgaaggacgggcggaagctcgtcgtgccgtgccgcccccaggacgagctgatcggccgcgcccggatctcccagggggccggctggagcctgcgcgagacggcgtgcctcggcaaggcctacgcccagatgtggtccctgatgtacttccaccggcgcgacctgcggctcgccagcaacgcgatctgcagcgccgtgcccgtccactgggtgcccacctcccgcaccacctggagcatccacgcccaccaccagtggatgacgaccgaggacatgctgaccgtgtggaaccgggtctggatcgaggacaacccgtggatggaggacaagacccccgtgacgacctgggagaacgtgccctacctggggaagcgcgaggaccagtggtgcggctccctcatcgggctgaccagccgggccacctgggcccagaacatccccacggcgatccagcaggtccgctccctgatcggcaacgaggagttcctcgactacatgccgagcatgaagcggttccgcaaggaggaggagtccgagggggccatctggtga

SEQ ID NO: 10399 - RNA, 9873 nt, synthetic construct
  misc_feature 1..9873: note = derived and/or modified CDS sequence (opt1) from DENV-3__DQ675519__SS-prME
  source 1..9873: mol_type = other RNA
acctccatctgcctgatgatgatgctccccgccaccctggccttccacctgacctcccgcgacggcgagccccggatgatcgtggggaagaacgagcgcggcaagagcctcctgttcaagaccgcctccgggatcaacatgtgcaccctgatcgccatggacctcggcgagatgtgcgacgacaccgtgacctacaagtgccccctgatcaccgaggtggagcccgaggacatcgactgctggtgcaacctgaccagcacctgggtgacgtacgggacctgcaaccaggccggcgagcaccggcgcgacaagcggtccgtggccctcgcgccccacgtgggcatggggctggacacccgcacccagacgtggatgagcgcggagggcgcctggcggcaggtcgagaaggtggagacctgggccttccgccaccccgggttcaccatcctggccctcttcctggcgcactacatcggcacctccctgacgcagaaggtggtgatcttcatcctcctgatgctggtcacccccagcatgaccatgcggtgcgtgggggtgggcaaccgcgacttcgtcgagggcctctccggggccacctgggtggacgtggtcctggagcacggcgggtgcgtgacgaccatggccaagaacaagcccaccctggacatcgagctccagaagaccgaggccacgcagctggccaccctgcggaagctctgcatcgagggcaagatcaccaacgtgaccacggacagccgctgccccacccagggcgaggcgatcctgccggaggagcaggaccagaactacgtctgcaagcacacctacgtggaccgggggtggggcaacgggtgcggcctgttcgggaagggctccctcgtgacctgcgccaagttccagtgcctggagagcatcgagggcaaggtcgtgcagcacgagaacctgaagtacacggtgatcatcaccgtccacaccggggaccagcaccaggtgggcaacgagacccagggggtcacggccgagatcacgccccaggcctccaccgtggaggccatcctccccgagtacggcaccctggggctggagtgcagcccccgcaccggcctcgacttcaacgagatgatcctgctgacgatgaagaacaaggcgtggatggtgcaccggcagtggttcttcgacctcccgctgccctggacctccggcgccaccaccgagacgcccacctggaacaagaaggagctgctcgtcaccttcaagaacgcccacgccaagaagcaggaggtggtggtcctggggagccaggagggcgccatgcacaccgcgctgacgggggccaccgagatccagacctccggcgggaccagcatcttcgccggccacctcaagtgccgcctgaagatggacaagctggagctcaagggcatgtcctacgccatgtgcctgaacgccttcgtgctgaagaaggaggtgagcgagacgcagcacgggaccatcctcatcaaggtcgagtacaagggcgaggacgcgccctgccggatcccgttcagcaccgaggacgggcagggcaaggcccacaacggccgcctgatcaccgccaaccccgtggtgacgaagaaggaggagcccgtcaacatcgaggccgagcccccgttcggggagtccaacatcgtgatcggcatcggggacaaggcgctgaagatcaactggtacaagaagggcagctccatcgggaagatgttcgaggccaccgcccggggcgcccgccggatggccatcctgggcgacaccgcgtgggacttcgggagcgtgggcggggtcctcaactccctgggcaagatggtgcaccagatcttcgggagcgcctacaccgccctgttctccggcgtgagctggatcatgaagatcggcatcggggtcctcctgacgtggatcggcctgaactccaagaacaccagcatgtccttcagctgcatcgtgatcgggatcatcaccctctacctgggcgccgtggtccaggccgacatggggtgcgtgatcaactggaagggcaaggagctgaagtgcggcaacgggatcttcgtgaccaacgaggtccacacgtggaccgagcagtacaagttccaggcggactcccccaagcgcctcgccaccgccatcgccggcgcctgggagaacggggtgtgcggcatccgcagcaccacgcggatggagaacctgctgtggaagcagatcgcgaacgagctcaactacatcctgtgggagaacaacatcaagctgaccgtggtcgtgggggacatcatcggcgtgctcgagcagggcaagcgcaccctgacgccccagcccatggagctgaagtactcctggaagacgtgggggaaggccaagatcgtcaccgccgagacccagaacagctccttcatcatcgacggcccgaacacccccgagtgccccagcgcctcccgggcgtggaacgtgtgggaggtggaggactacgggttcggcgtcttcacgaccaacatctggctcaagctgcgcgaggtgtacacccagctgtgcgaccaccggctcatgagcgccgccgtgaaggacgagcgcgccgtccacgccgacatgggctactggatcgagagccagaagaacgggtcctggaagctggagaaggcgagcctgatcgaggtgaagacctgcacctggcccaagtcccacacgctctggagcaacggcgtgctggagtccgacatgatcatccccaagagcctggccgggcccatctcccagcacaaccaccggcccggctaccacacccagaccgccgggccgtggcacctcggcaagctggagctggacttcaactactgcgagggcaccacggtcgtgatcaccgagaactgcgggacccgcggccccagcctccggaccacgaccgtgtccgggaagctgatccacgagtggtgctgccgcagctgcaccctgccgcccctccggtacatgggcgaggacgggtgctggtacggcatggagatccgcccgatcaacgagaaggaggagaacatggtcaagtccctggtgagcgccggctccgggaaggtggacaacttcaccatgggcgtcctgtgcctcgccatcctgttcgaggaggtgatgcgggggaagttcggcaagaagcacatgatcgcgggggtgctgttcacgttcgtcctcctgctgagcggccagatcacctggcgcgacatggcccacaccctcatcatgatcggctccaacgccagcgaccggatggggatgggcgtgacctacctggccctgatcgccacgttcaagatccagcccttcctcgcgctggggttcttcctgcgcaagctcacctcccgggagaacctgctgctcggcgtgggcctggccatggccaccaccctgcagctccccgaggacatcgagcagatggccaacggggtcgcgctgggcctgatggccctcaagctgatcacgcagttcgagacctaccagctgtggaccgccctcgtgagcctgatgtgcagcaacaccatcttcacgctgaccgtcgcctggcgcaccgccaccctcatcctggcggggatctccctgctccccgtgtgccagagctccagcatgcggaagacggactggctgccgatgaccgtggccgccatgggcgtgccgcccctgcccctcttcatcttctccctgaaggacaccctgaagcgccgcagctggccgctcaacgagggggtgatggccatcggcctggtgtccatcctggccagctccctcctgcggaacgacgtccccatggcgggccccctggtggccgggggcctcctgatcgcctgctacgtgatcaccgggacgagcgccgacctgaccgtcgagaaggccgcggacgtgacctgggaggaggaggccgagcagaccggcgtgtcccacaacctcatgatcacggtcgacgacgacgggaccatgcgcatcaaggacgacgagaccgagaacatcctgaccgtgctgctcaagaccgccctgctgatcgtgagcggcatcttcccctactccatcccggccacgctcctggtctggcacacctggcagaagcagacccagcggagcggcgtgctgtgggacgtgcccagcccgcccgagacccagaaggccgagctcgaggagggggtctaccgcatcaagcagcagggcatcttcgggaagacccaggtgggcgtggggatccagaaggagggcgtcttccacaccatgtggcacgtgacccggggcgcggtgctgacccacaacgggaagcgcctggagccgaactgggccagcgtcaagaaggacctcatctcctacggcgggggctggcggctgagcgcccagtggcagaagggggaggaggtccaggtgatcgccgtcgagcccggcaagaaccccaagaacttccagacgatgcccggcatcttccagaccaccaccggggagatcggcgcgatcgccctggacttcaagccggggacgtccggcagccccatcatcaaccgcgagggcaaggtggtggggctgtacggcaacggggtcgtgaccaagaacggcgggtacgtgagcggcatcgcccagaccaacgccgagcccgacggcccgacccccgagctcgaggaggagatgttcaagaagcggaacctgacgatcatggacctgcaccccgggtccggcaagacccgcaagtacctccccaccatcgtccgggaggccatcaagcgccggctgcgcaccctgatcctcgcgccgacgcgggtggtggccgccgagatggaggaggccctgaaggggctgcccatccgctaccagaccaccgccaccaagagcgagcacacgggcaaggagatcgtcgacctcatgtgccacgcgaccttcaccatgcggctgctgtcccccgtgcgcgtgcccaactacaacctcatcatcatggacgaggcccacttcaccgacccggccagcatcgccgcccgggggtacatctccacgcgcgtcggcatgggcgaggcggccgccatcttcatgaccgccacgccgcccgggaccgcggacgccttcccccagagcaacgccccgatccaggacgaggagcgggacatccccgagcgctcctggaacagcggcaacgagtggatcacggacttcgtggggaagaccgtgtggttcgtcccctccatcaaggccggcaacgacatcgccaactgcctgcgcaagaacgggaagaaggtgatccagctgagccggaagaccttcgacaccgagtaccagaagacgaagctcaacgactgggacttcgtggtcaccaccgacatctccgagatgggcgcgaacttcaaggccgaccgcgtgatcgacccccggcgctgcctgaagccggtgatcctgaccgacggccccgagcgggtcatcctcgccgggcccatgcccgtgacggtggccagcgccgcgcagcgccggggccgcgtcgggcggaacccgcagaaggagaacgaccagtacatcttcaccggccagcccctgaacaacgacgaggaccacgcccactggaccgaggccaagatgctgctcgacaacatcaacacccccgaggggatcatccccgccctgttcgagccggagcgcgagaagtccgccgcgatcgacggcgagtaccggctgaagggcgagagccgcaagaccttcgtggagctcatgcggcgcggggacctgcccgtctggctggcccacaaggtggcctccgagggcatcaagtacacggaccggaagtggtgcttcgacggggagcgcaacaaccagatcctcgaggagaacatggacgtggagatctggaccaaggagggcgagaagaagaagctgcggccccgctggctggacgcccggacctacagcgaccccctcgcgctgaaggagttcaaggacttcgccgccggccgcaagtccatcgccctggacctcgtcaccgagatcgggcgcgtgccgagccacctggcctaccggacgcgctccgcgctggacaacctcgtgatgctgcacaccagcgagcacggcgggcgggcctaccgccacgccgtcgaggagctgcccgagaccatggagaccctcctgctgctcggcctgatgatcctgctcaccggcggggccatgctgttcctgatcagcgggaaggggatcggcaagacctccatcgggctcatctgcgtggtggccagctccggcatgctgtggatggcggacgtccccctgcagtggatcgccagcgccatcgtgctcgagttcttcatgatggtgctgctgatcccggagcccgagaagcagcggacgccccaggacaaccagctcgcctacgtcgtgatcgggatcctgaccctggccgcgatcgtggccgccaacgagatgggcctcctggagacgaccaagcgcgacctgggcatgtccaaggagcccggggtcgtgagcccgacctcctacctcgacgtggacctgcaccccgccagcgcctggaccctgtacgcggtcgccacgaccgtgatcacccccatgctccggcacaccatcgagaactccacggccaacgtgagcctggccgcgatcgccaaccaggccgtcgtgctgatgggcctcgacaaggggtggcccatctccaagatggacctgggcgtgccgctgctcgccctggggtgctacagccaggtcaaccccctgaccctcaccgccgcggtgctgctgctcgtgacccactacgccatcatcggccccggcctgcaggccaaggccacgcgcgaggcccagaagcggaccgcggccgggatcatgaagaaccccaccgtcgacggcatcatgaccatcgacctggacccggtgatctacgactccaagttcgagaagcagctcggccaggtgatgctgctggtcctctgcgccgtgcagctgctgctcatgcgcacgagctgggccttctgcgaggccctgaccctggcgaccggccccatcaccacgctctgggagggctcccccgggaagttctggaacaccaccatcgccgtgagcatggccaacatcttccggggctcctacctggccggggcgggcctggccttcagcatcatgaagtccgtcgggaccggcaagcgcggcacggggagccagggcgagaccctcggggagaagtggaagaagaagctgaaccagctgagccggaaggagttcgacctctacaagaagtccggcatcaccgaggtggaccgcaccaaggccaaggaggggctgaagcggggcgagaccacgcaccacgccgtgagccgcggctccgccaagctgcagtggttcgtcgagcggaacatggtgatccccgaggggcgcgtgatcgacctcggctgcgggcggggcgggtggagctactactgcgcgggcctgaagaaggtcaccgaggtgcgcggctacaccaagggcgggccggggcacgaggagcccgtgcccatgtccacctacggctggaacatcgtcaagctgatgagcgggaaggacgtgttctacctcccgcccgagaagtgcgacacgctgctgtgcgacatcggcgagtccagcccctcccccaccgtggaggagagccggaccatccgcgtcctgaagatggtggagccctggctcaagaacaaccagttctgcatcaaggtgctgaacccctacatgcccaccgtcatcgagcacctggagcgcctccagcggaagcacggcgggatgctggtgcgcaaccccctgtcccggaacagcacgcacgagatgtactggatctccaacggcaccgggaacatcgtgagctccgtcaacatggtgagccgcctcctgctgaaccggttcaccatgacccaccgccggcccacgatcgagaaggacgtcgacctcggcgccggcacccgccacgtgaacgccgagccggagacccccaacatggacgtgatcggggagcggatccgccggatcaaggaggagcactccagcacctggcactacgacgacgagaacccctacaagacgtgggcctaccacggctcctacgaggtcaaggccaccgggagcgcgagctccatgatcaacggcgtggtgaagctgctgaccaagccgtgggacgtcgtgcccaccgtgacgcagatggccatgaccgacaccacccccttcgggcagcagcgcgtcttcaaggagaaggtggacacgcggacgccccgcccgatgcccggcacccggaaggtgatggagatcaccgccgagtggctctggcgcaccctgggccggaacaagcgcccccggctgtgcacccgcgaggagttcaccaagaaggtccgcaccaacgccgccatgggggcggtgttcacggaggagaaccagtgggacagcgcccgggccgccgtggaggacgaggagttctggaagctcgtcgaccgcgagcgggagctgcacaagctgggcaagtgcgggtcctgcgtgtacaacatgatgggcaagcgcgagaagaagctcggggagttcggcaaggcgaagggcagccgggccatctggtacatgtggctgggggcccgctacctggagttcgaggccctcggcttcctgaacgaggaccactggttctcccgggagaacagctactccggggtggagggcgaggggctgcacaagctcggctacatcctgcgcgacatcagcaagacccccggcggggccatgtacgcggacgacaccgccggctgggacacccggatcacggaggacgacctgcacaacgaggagaagatcacccagcagatggacccggagcaccgccagctcgccaacgccatcttcaagctgacctaccagaacaaggtcgtgaaggtgcagcggcccacccccaaggggaccgtcatggacatcatctcccgcaaggaccagcggggcagcggccaggtggggacgtacggcctgaacaccttcaccaacatggaggcccagctcatccgccagatggagggggagggcgtgctgtccaaggcggacctggagaacccccacctcccggagaagaagatcacccagtggctggagacgaagggggtcgagcggctgaagcgcatggccatcagcggcgacgactgcgtggtgaagcccatcgacgaccggttcgccaacgccctcctggccctgaacgacatgggcaaggtccgcaaggacatcccccagtggcagccctccaaggggtggcacgactggcagcaggtcccgttctgcagccaccacttccacgagctcatcatgaaggacggccggaagctggtggtcccctgccgcccccaggacgagctgatcgggcgggcgcgcatctcccagggcgccgggtggagcctcaaggagaccgcctgcctgggcaaggcctacgcccagatgtggtccctgatgtacttccaccgccgggacctccgcctggcgagcaacgccatctgctccgccgtgcccgtgcactgggtcccgaccagccggaccacgtggagcatccacgcccaccaccagtggatgaccaccgaggacatgctgaccgtgtggaaccgcgtgtggatcgaggacaacccctggatggaggacaagacgcccgtcaccacctgggaggacgtgccctacctcggcaagcgggaggaccagtggtgcgggtccctgatcggcctgaccagccgcgcgacgtgggcccagaacatcctcaccgccatccagcaggtccggtccctgatcgggaacgaggagttcctggactacatgccgagcatgaagcgcttccggaaggaggaggagtccgagggcgccatctggtga

SEQ ID NO: 10400 - RNA, 9873 nt, synthetic construct
  misc_feature 1..9873: note = derived and/or modified CDS sequence (opt1) from DENV-3__DQ675521__SS-prME
  source 1..9873: mol_type = other RNA
accagcttctgcctgatgatgatgctccccgccaccctggccttccacctgacgtcccgcgacggcgagccgcggatgatcgtggggaagaacgagcgcggcaagagcctcctgttcaagaccgcgtccgggatcaacatgtgcaccctgatcgccatggacctcggcgagatgtgcgacgacaccgtcacgtacaagtgccccctgatcgccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccatcctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgacacccagggggtgaccgtcgagatcacgccccaggccagcaccgtggaggccgtgctgcccgagtacggcaccctggggctcgagtgctccccgcgcaccggcctggacttcaacgagatgatcctgctcaccatgaagaacaaggcgtggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgccatgcacaccgcgctcaccggggccacggagatccagaacagcggcgggacctccatcttcgccggccacctgaagtgccggctgaagatggacaagctcgagctgaagggcatgagctacgccatgtgcctgaacaccttcgtgctcaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctgaagatcaactggtacaagaagggctccagcatcgggaagatgttcgaggcgacggcccggggcgcccgccggatggccatcctcggcgacaccgcctgggacttcgggtccgtcggcggggtgctgaacagcctgggcaagatggtgcaccagatcttcgggtccgcgtacaccgccctcttcagcggcgtctcctggatcatgaagatcggcatcggggtgctgctgacctggatcggcctcaacagcaagaacacgtccatgagcttctcctgcatcgtgatcgggatcatcaccctgtacctgggcgccgtcgtgcaggccgacatggggtgcgtgatcaactggaagggcaaggagctcaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctgctctggaagcagatcgccaacgagctgaactacatcctgtgggagaacaacatcaagctcacggtcgtggtgggggacatcatcggcgtcctggagcagggcaagcgcaccctgaccccccagccgatggagctcaagtactcctggaagacctgggggaaggcgaagatcgtgacggccgagatccagaacagctccttcatcatcgacggccccaacacccccgagtgccccagcgcctcccgggcctggaacgtgtgggaggtcgaggactacgggttcggcgtgttcaccaccaacatctggctgaagctgcgcgagatgtacacgcagagctgcgaccaccggctcatgagcgcggccatcaaggacgagcgcgccgtgcacgccgacatgggctactggatcgagtcccagaagaacgggagctggaagctggagaaggcctccttcatcgaggtcaagacctgcacctggccgaagagccacaccctgtggtccaacggcgtgctcgagagcgacatgatcatccccaagtccctggcggggcccatcagccagcacaaccaccggccgggctaccacacccagacggccgggccctggcacctgggcaagctcgagctggacttcaactactgcgagggcaccaccgtggtcatcaccgagaactgcgggacgcgcggcccctccctgcggaccaccaccgtgagcgggaagctcatccacgagtggtgctgccgctcctgcacgctgcccccgctgcggtacatgggcgaggacgggtgctggtacggcatggagatccgccccatcaacgagaaggaggagaacatggtgaagagcctcgtctccgccggcagcgggaaggtggacaacttcaccatgggcgtgctgtgcctggccatcctcttcgaggaggtcatgcgggggaagttcggcaagaagcacatgatcgtgggggtgctgttcaccttcgtcctgctcctgtccggccagatcacctggcgcgacatggcccacacgctgatcatgatcggcagcaacgcgtccgaccggatggggatgggcgtgacctacctcgccctgatcgccaccttcaagatccagcccttcctggccctcgggttcttcctgcgcaagctgaccagccgggagaacctcctgctgggcgtgggcctcgccatggcgacgaccctgcagctgcccgaggacatcgagcagatggccaacgggatcgccctcggcctgatgaccctgaagctcatcacccagttcgagacgtaccagctgtggaccgccctggtcagcctcacctgctccaacaccatcttcacgctgaccgtggcgtggcgcaccgccaccctgatcctcgccggggtcagcctgctgccgctctgccagtccagctccatgcggaagacggactggctgcccatgaccgtggccgccatgggcgtgccccccctgccgctcttcatcttcagcctgaaggacacccccaagcgccgctcctggcccctgaacgagggggtcatggcggtgggcctcgtgagcatcctggcctccagcctgctccggaacgacgtccccatggccggcccgctggtggccgggggcctgctcatcgcctgctacgtgatcaccgggacgtccgcggacctgaccgtcgagaaggccgccgacgtgacctgggaggaggaggccgagcagaccggcgtgagccacaacctgatgatcacggtcgacgacgacgggaccatgcgcatcaaggacgacgagaccgagaacatcctcaccgtgctgctgaagaccgccctcctgatcgtgtccggcatcttcccctacagcatccccgcgacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacgcaggtgggcgtgggggtccagaaggagggcgtgttccacaccatgtggcacgtgacccggggcgccgtcctcacccacaacgggaagcgcctggagcccaactgggcctccgtgaagaaggacctgatcagctacggcgggggctggcggctctccgcccagtggcagaagggggaggaggtgcaggtcatcgcggtggagcccggcaagaacccgaagaacttccagacgatgcccggcatcttccagaccaccaccggggagatcggcgccatcgccctggacttcaagcccgggacgagcggcagcccgatcatcaaccgcgagggcaaggtggtcgggctgtacggcaacggggtggtgaccaagaacggcgggtacgtctccggcatcgcccagaccaacgcggagcccgacggccccacccccgagctggaggaggagatgttcaagaagcggaacctcacgatcatggacctgcacccggggagcggcaagacccgcaagtacctgcccgccatcgtgcgggaggccatcaagcgccggctccgcaccctgatcctggcccccacccgggtggtcgccgcggagatggaggaggccctcaaggggctgcccatccgctaccagacgaccgccaccaagtccgagcacaccggccgggagatcgtggacctgatgtgccacgccacgttcaccatgcgcctcctgagcccggtgcgggtccccaactacaacctgatcatcatggacgaggcccacttcaccgaccccgcgtccatcgccgcccgcgggtacatcagcacccgggtgggcatgggcgaggccgccgcgatcttcatgacggccacccccccggggaccgccgaggccttcccccagtccaacgcgcccatccaggacgaggagcgcgacatccccgagcgcagctggaactccggcaacgagtggatcaccgacttcgtggggaagacggtctggttcgtgccgagcatcaaggccggcaacgacatcgccaactgcctccggaagaacgggaagaaggtgatccagctgtcccgcaagaccttcgacaccgagtaccagaagacccggctgaacgactgggacttcgtcgtgacgaccgacatcagcgagatgggcgccaacttccgcgccgaccgggtgatcgacccccgccggtgcctcaagcccgtcatcctgaccgacggccccgagcgcgtgatcctggcggggccgatgcccgtgaccgccgcctccgccgcccagcggcgcggccgggtcgggcgcaacccccagaaggagaacgaccagtacatcttcacgggccagcccctcaacaacgacgaggaccacgcgcactggaccgaggccaagatgctgctggacaacatcaacaccccggaggggatcatccccgccctcttcgagcccgagcgggagaagagcgccgccatcgacggcgagtaccgcctgaagggcgagtcccggaagaccttcgtggagctgatgcgccggggggacctccccgtctggctggcgcacaaggtggccagcgagggcatcaagtacaccgaccgcaagtggtgcttcgacggggagcggaacaaccagatcctggaggagaacatggacgtggagatctggacgaaggagggcgagcgcaagaagctccgcccgcggtggctggacgcccgcacctactccgaccccctggccctcaaggagttcaaggacttcgcggccggccggaagagcatcgccctggacctggtcaccgagatcgggcgcgtgccctcccacctcgcccaccggacccgcaacgccctggacaacctggtgatgctccacacgagcgagcacggcgggcgggcgtaccgccacgccgtcgaggagctgccggagaccatggagaccctgctcctgctgggcctcatgatcctgctgaccgggggcgccatgctcttcctgatcagcggcaaggggatcggcaagacgtccatcgggctgatctgcgtgatcgtgagctccggcatgctctggatggccgacgtccccctgcagtggatcgccagcgcgatcgtgctggagttcttcatgatggtgctcctgatccccgagcccgagaagcagcggaccccgcaggacaaccagctggcctacgtcgtgatcgggatcctcaccctggccgccatcgtggccgcgaacgagatgggcctgctcgagaccacgaagcgcgacctgggcatgtccaaggagcccggggtcgtgagccccacctcctacctggacgtggacctccaccccgccagcgcctggaccctgtacgccgtcgccaccacggtgatcaccccgatgctgcggcacaccatcgagaactccaccgcgaacgtgagcctcgccgccatcgccaaccaggcggtcgtgctgatgggcctggacaaggggtggcccatctccaagatggacctcggcgtgcccctgctggccctcgggtgctacagccaggtcaaccccctgacgctgaccgccgccgtgctcctgctggtgacccactacgccatcatcggcccgggcctccaggcgaaggccacccgcgaggcccagaagcggacggccgccgggatcatgaagaaccccaccgtcgacggcatcatgaccatcgacctggaccccgtgatctacgactccaagttcgagaagcagctggggcaggtgatgctcctggtcctgtgcgcggtgcagctcctgctgatgcgcaccagctgggccctctgcgaggccctgacgctggccaccggccccatcaccaccctctgggagggctccccggggaagttctggaacacgaccatcgccgtgagcatggcgaacatcttccggggctcctacctggccggggccggcctggccttcagcatcatgaagtccgtcgggaccggccgccggggcaccgggagccagggcgagacgctcggggagaagtggaagaagaagctgaaccagctgagccgcaaggagttcgacctctacaagaagtccggcatcaccgaggtggaccggaccgaggcgaaggaggggctgaagcgcggcgagaccacccaccacgccgtgagccggggctccgccaagctgcagtggttcgtcgagcgcaacatggtgatccccgaggggcgcgtgatcgacctcggctgcgggcggggcgggtggagctactactgcgccggcctgaagaaggtcacggaggtgcgcggctacaccaaggggggccccgggcacgaggagcccgtgccgatgtccacctacggctggaacatcgtcaagctgatgagcgggaaggacgtgttctacctcccccccgagaagtgcgacaccctgctgtgcgacatcggcgagtccagcccctccccgacggtggaggagagccggaccatccgcgtcctgaagatggtggagccctggctcaagaacaaccagttctgcatcaaggtgctgaacccctacatgcccaccgtcatcgagcacctggagcggctccagcgcaagtacggcgggatgctggtgcggaacccgctgtcccgcaacagcacccacgagatgtactggatctccaacggcacggggaacatcgtgagctccgtcaacatggtgagccggctcctgctgaaccgcttcaccatgacccaccggcgccccaccatcgagaaggacgtcgacctcggcgccggcacgcggcacgtgaacgcggagcccgagaccccgaacatggacgtgatcggggagcgcatcaagcggatcaaggaggagcactccagcacctggcactacgacgacgagaacccctacaagacctgggcctaccacggctcctacgaggtcaaggccacggggagcgccagctccatgatcaacggcgtggtgaagctgctgaccaagccctgggacgtcgtgcccatggtgacccagatggccatgaccgacacgaccccgttcgggcagcagcgcgtcttcaaggagaaggtggacacccggaccccccgccccatgcccggcacgcggaaggtgatggagatcaccgcggagtggctctggcgcaccctgggccgcaacaagaagccgcggctgtgcacccgcgaggagttcacgaagaaggtccggaccaacgccgccatgggggccgtgttcaccgaggagaaccagtgggacagcgcccgcgcggccgtggaggacgaggagttctggaagctcgtcgaccgggagcgcgagctgcacaagctgggcaagtgcgggtcctgcgtgtacaacatgatgggcaagcgggagaagaagctcggggagttcggcaaggccaagggcagccgcgccatctggtacatgtggctgggggcgcggtacctggagttcgaggccctcggcttcctgaacgaggaccactggttctcccgcgagaacagctactccggggtggagggcgaggggctgcacaagctcggctacatcctgcgggacatcagcaagatccccggcggggccatgtacgccgacgacaccgccggctgggacacgcgcatcaccgaggacgacctgcacaacgaggagaagatcacccagcagatggaccccgagcaccggcagctcgcgtccgccatcttcaagctgacctaccagaacaaggtcgtgaaggtgcagcgccccacgccgaaggggaccgtcatggacatcatcagccggaaggaccagcgcggctccggccaggtggggacctacggcctgaacaccttcaccaacatggaggcccagctcgtgcggcagatggagggggagggcgtcctgagcaaggccgacctggagaacccccacctcctggagaagaagatcacgcagtggctggagaccaagggggtggagcgcctcaagcggatggccatctccggcgacgactgcgtggtcaagcccatcgacgaccgcttcgcgaacgccctgctggccctcaacgacatgggcaaggtgcggaaggacatcccccagtggcagccgagcaaggggtggcacgactggcagcaggtgcccttctgctcccaccacttccacgagctgatcatgaaggacggccgcaagctggtcgtgccctgccgcccccaggacgagctcatcgggcgggcccgcatcagccagggcgccgggtggtccctgaaggagaccgcgtgcctgggcaaggcctacgcccagatgtggagcctcatgtacttccaccggcgcgacctgcggctggcctccaacgccatctgcagcgcggtgccggtccactgggtgcccaccagccgcacgacctggtccatccacgcccaccaccagtggatgaccaccgaggacatgctcacggtgtggaaccgggtctggatcgaggacaacccctggatggaggacaagacccccgtgaccacctgggaggacgtgccgtacctgggcaagcgcgaggaccagtggtgcgggagcctgatcggcctcacgtcccgggccacctgggcccagaacatcctgaccgcgatccagcaggtccgcagcctgatcggggacgaggagttcctcgactacatgccctccatgaagcggttccgcaaggaggaggagagcgagggcgccatctggtga

SEQ ID NO: 10401 - RNA, 9873 nt, synthetic construct
  misc_feature 1..9873: note = derived and/or modified CDS sequence (opt1) from DENV-3__DQ675522__SS-prME
  source 1..9873: mol_type = other RNA
accagcttctgcctgatgatgatgctccccgccaccctggccttccacctgacgtcccgcgacggcgagccgcggatgatcgtggggaagaacgagcgcggcaagagcctcctgttcaagaccgcgtccgggatcaacatgtgcaccctgatcgccatggacctcggcgagatgtgcgacgacaccgtcacgtacaagtgccccctgatcgccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccatcctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgacacccagggggtgaccgtcgagatcacgccccaggccagcaccgtggaggccgtgctgcccgagtacggcaccctggggctcgagtgctccccgcgcaccggcctggacttcaacgagatgatcctgctcaccatgaagaacaaggcgtggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgccatgcacaccgcgctcaccggggccacggagatccagaacagcggcgggacctccatcttcgccggccacctgaagtgccggctgaagatggacaagctcgagctgaagggcatgagctacgccatgtgcctgaacaccttcgtgctcaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctgaagatcaactggtacaagaagggctccagcatcgggaagatgttcgaggcgacggcccggggcgcccgccggatggccatcctcggcgacaccgcctgggacttcgggtccgtcggcggggtgctgaacagcctgggcaagatggtgcaccagatcttcgggtccgcgtacaccgccctcttcagcggcgtctcctggatcatgaagatcggcatcggggtgctgctgacctggatcggcctcaacagcaagaacacgtccatgagcttctcctgcatcgtgatcgggatcatcaccctgtacctgggcgccgtcgtgcaggccgacatggggtgcgtgatcaactggaagggcaaggagctcaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctgctctggaagcagatcgccaacgagctgaactacatcctgtgggagaacaacatcaagctcacggtcgtggtgggggacatcatcggcgtcctggagcagggcaagcgcaccctgaccccccagccgatggagctcaagtactcctggaagacctgggggaaggcgaagatcgtgacggccgagatccagaacagctccttcatcatcgacggccccaacacccccgagtgccccagcgcctcccgggcctggaacgtgtgggaggtcgaggactacgggttcggcgtgttcaccaccaacatctggctgaagctgcgcgagatgtacacgcagagctgcgaccaccggctcatgagcgcggccatcaaggacgagcgcgccgtgcacgccgacatgggctactggatcgagtcccagaagaacgggagctggaagctggagaaggcctccttcatcgaggtcaagacctgcacctggccgaagagccacaccctgtggtccaacggcgtgctcgagagcgacatgatcatccccaagtccctggcggggcccatcagccagcacaaccaccggccgggctaccacacccagacggccgggccctggcacctgggcaagctcgagctggacttcaactactgcgagggcaccaccgtggtcatcaccgagaactgcgggacgcgcggcccctccctgcggaccaccaccgtgagcgggaagctcatccacgagtggtgctgccgctcctgcacgctgcccccgctgcggtacatgggcgaggacgggtgctggtacggcatggagatccgccccatcaacgagaaggaggagaacatggtgaagagcctcgtctccgccggcagcgggaaggtggacaacttcaccatgggcgtgctgtgcctggccatcctcttcgaggaggtcatgcgggggaagttcggcaagaagcacatgatcgtgggggtgctgttcaccttcgtcctgctcctgtccggccagatcacctggcgcgacatggcccacacgctgatcatgatcggcagcaacgcgtccgaccggatggggatgggcgtgacctacctcgccctgatcgccaccttcaagatccagcccttcctggccctcgggttcttcctgcgcaagctgaccagccgggagaacctcctgctgggcgtgggcctcgccatggcgacgaccctgcagctgcccgaggacatcgagcagatggccaacgggatcgccctcggcctgatgaccctgaagctcatcacccagttcgagacgtaccagctgtggaccgccctggtcagcctcacctgctccaacaccatcttcacgctgaccgtggcgtggcgcaccgccaccctgatcctcgccggggtcagcctgctgccgctctgccagtccagctccatgcggaagacggactggctgcccatgaccgtggccgccatgggcgtgccccccctgccgctcttcatcttcagcctgaaggacacccccaagcgccgctcctggcccctgaacgagggggtcatggcggtgggcctcgtgagcatcctggcctccagcctgctccggaacgacgtccccatggccggcccgctggtggccgggggcctgctcatcgcctgctacgtgatcaccgggacgtccgcggacctgaccgtcgagaaggccgccgacgtgacctgggaggaggaggccgagcagaccggcgtgagccacaacctgatgatcacggtcgacgacgacgggaccatgcgcatcaaggacgacgagaccgagaacatcctcaccgtgctgctgaagaccgccctcctgatcgtgtccggcatcttcccctacagcatccccgcgacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacgcaggtgggcgtgggggtccagaaggagggcgtgttccacaccatgtggcacgtgacccggggcgccgtcctcacccacaacgggaagcgcctggagcccaactgggcctccgtgaagaaggacctgatcagctacggcgggggctggcggctctccgcccagtggcagaagggggaggaggtgcaggtcatcgcggtggagcccggcaagaacccgaagaacttccagacgatgcccggcatcttccagaccaccaccggggagatcggcgccatcgccctggacttcaagcccgggacgagcggcagcccgatcatcaaccgcgagggcaaggtggtcgggctgtacggcaacggggtggtgaccaagaacggcgggtacgtctccggcatcgcccagaccaacgcggagcccgacggccccacccccgagctggaggaggagatgttcaagaagcggaacctcacgatcatggacctgcacccggggagcggcaagacccgcaagtacctgcccgccatcgtgcgggaggccatcaagcgccggctccgcaccctgatcctggcccccacccgggtggtcgccgcggagatggaggaggccctcaaggggctgcccatccgctaccagacgaccgccaccaagtccgagcacaccggccgggagatcgtggacctgatgtgccacgccacgttcaccatgcgcctcctgagcccggtgcgggtccccaactacaacctgatcatcatggacgaggcccacttcaccgaccccgcgtccatcgccgcccgcgggtacatcagcacccgggtgggcatgggcgaggccgccgcgatcttcatgacggccacccccccggggaccgccgaggccttcccccagtccaacgcgcccatccaggacgaggagcgcgacatccccgagcgcagctggaactccggcaacgagtggatcaccgacttcgtggggaagacggtctggttcgtgccgagcatcaaggccggcaacgacatcgccaactgcctccggaagaacgggaagaaggtgatccagctgtcccgcaagaccttcgacaccgagtaccagaagacccggctgaacgactgggacttcgtcgtgacgaccgacatcagcgagatgggcgccaacttcaaggccgaccgcgtgatcgacccccggcgctgcctcaagcccgtcatcctgaccgacggccccgagcgggtgatcctggcggggccgatgcccgtgaccgccgcctccgccgcccagcgccggggccgcgtcgggcggaacccccagaaggagaacgaccagtacatcttcacgggccagcccctcaacaacgacgaggaccacgcgcactggaccgaggccaagatgctgctggacaacatcaacaccccggaggggatcatccccgccctcttcgagcccgagcgcgagaagagcgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacggggagcgcaacaaccagatcctggaggagaacatggacgtggagatctggacgaaggagggcgagcggaagaagctccgcccgcgctggctggacgcccggacctactccgaccccctggccctcaaggagttcaaggacttcgcggccggccgcaagagcatcgccctggacctggtcaccgagatcgggcgggtgccctcccacctcgcccaccgcacccggaacgccctggacaacctggtgatgctccacacgagcgagcacggcgggcgcgcgtaccggcacgccgtcgaggagctgccggagaccatggagaccctgctcctgctgggcctcatgatcctgctgaccgggggcgccatgctcttcctgatcagcggcaaggggatcggcaagacgtccatcgggctgatctgcgtgatcgtgagctccggcatgctctggatggccgacgtccccctgcagtggatcgccagcgcgatcgtgctggagttcttcatgatggtgctcctgatccccgagcccgagaagcagcgcaccccgcaggacaaccagctggcctacgtcgtgatcgggatcctcaccctggccgccatcgtggccgcgaacgagatgggcctgctcgagaccacgaagcgggacctgggcatgtccaaggagcccggggtcgtgagccccacctcctacctggacgtggacctccaccccgccagcgcctggaccctgtacgccgtcgccaccacggtgatcaccccgatgctgcgccacaccatcgagaactccaccgcgaacgtgagcctcgccgccatcgccaaccaggcggtcgtgctgatgggcctggacaaggggtggcccatctccaagatggacctcggcgtgcccctgctggccctcgggtgctacagccaggtcaaccccctgacgctgaccgccgccgtgctcctgctggtgacccactacgccatcatcggcccgggcctccaggcgaaggccacccgggaggcccagaagcgcacggccgccgggatcatgaagaaccccaccgtcgacggcatcatgaccatcgacctggaccccgtgatctacgactccaagttcgagaagcagctggggcaggtgatgctcctggtcctgtgcgcggtgcagctcctgctgatgcggaccagctgggccctctgcgaggccctgacgctggccaccggccccatcaccaccctctgggagggctccccggggaagttctggaacacgaccatcgccgtgagcatggcgaacatcttccgcggctcctacctggccggggccggcctggccttcagcatcatgaagtccgtcgggaccggccggcgcggcaccgggagccagggcgagacgctcggggagaagtggaagaagaagctgaaccagctgagccggaaggagttcgacctctacaagaagtccggcatcaccgaggtggaccgcaccgaggcgaaggaggggctgaagcggggcgagaccacccaccacgccgtgagccgcggctccgccaagctgcagtggttcgtcgagcggaacatggtgatccccgaggggcgcgtgatcgacctcggctgcgggcgcggcgggtggagctactactgcgccggcctgaagaaggtcacggaggtgcggggctacaccaaggggggccccgggcacgaggagcccgtgccgatgtccacctacggctggaacatcgtcaagctgatgagcgggaaggacgtgttctacctcccccccgagaagtgcgacaccctgctgtgcgacatcggcgagtccagcccctccccgacggtggaggagagccgcaccatccgggtcctgaagatggtggagccctggctcaagaacaaccagttctgcatcaaggtgctgaacccctacatgcccaccgtcatcgagcacctggagcgcctccagcggaagtacggcgggatgctggtgcgcaacccgctgtcccggaacagcacccacgagatgtactggatctccaacggcacggggaacatcgtgagctccgtcaacatggtgagccgcctcctgctgaaccggttcaccatgacccaccgccggcccaccatcgagaaggacgtcgacctcggcgccggcacgcgccacgtgaacgcggagcccgagaccccgaacatggacgtgatcggggagcggatcaagcgcatcaaggaggagcactccagcacctggcactacgacgacgagaacccctacaagacctgggcctaccacggctcctacgaggtcaaggccacggggagcgccagctccatgatcaacggcgtggtgaagctgctgaccaagccctgggacgtcgtgcccatggtgacccagatggccatgaccgacacgaccccgttcgggcagcagcgggtcttcaaggagaaggtggacacccgcaccccccggcccatgcccggcacgcgcaaggtgatggagatcaccgcggagtggctctggcggaccctgggccgcaacaagaagccgcgcctgtgcacccgggaggagttcacgaagaaggtccgcaccaacgccgccatgggggccgtgttcaccgaggagaaccagtgggacagcgcccgggcggccgtggaggacgaggagttctggaagctcgtcgaccgcgagcgggagctgcacaagctgggcaagtgcgggtcctgcgtgtacaacatgatgggcaagcgcgagaagaagctcggggagttcggcaaggccaagggcagccgggccatctggtacatgtggctgggggcgcgctacctggagttcgaggccctcggcttcctgaacgaggaccactggttctcccgggagaacagctactccggggtggagggcgaggggctgcacaagctcggctacatcctgcgcgacatcagcaagatccccggcggggccatgtacgccgacgacaccgccggctgggacacgcggatcaccgaggacgacctgcacaacgaggagaagatcacccagcagatggaccccgagcaccgccagctcgcgtccgccatcttcaagctgacctaccagaacaaggtcgtgaaggtgcagcggcccacgccgaaggggaccgtcatggacatcatcagccgcaaggaccagcggggctccggccaggtggggacctacggcctgaacaccttcaccaacatggaggcccagctcgtgcgccagatggagggggagggcgtcctgagcaaggccgacctggagaacccccacctcctggagaagaagatcacgcagtggctggagaccaagggggtggagcggctcaagcgcatggccatctccggcgacgactgcgtggtcaagcccatcgacgaccggttcgcgaacgccctgctggccctcaacgacatgggcaaggtgcgcaaggacatcccccagtggcagccgagcaaggggtggcacgactggcagcaggtgcccttctgctcccaccacttccacgagctgatcatgaaggacggccggaagctggtcgtgccctgccgcccccaggacgagctcatcgggcgcgcccggatcagccagggcgccgggtggtccctgaaggagaccgcgtgcctgggcaaggcctacgcccagatgtggagcctcatgtacttccaccgccgggacctgcgcctggcctccaacgccatctgcagcgcggtgccggtccactgggtgcccaccagccggacgacctggtccatccacgcccaccaccagtggatgaccaccgaggacatgctcacggtgtggaaccgcgtctggatcgaggacaacccctggatggaggacaagacccccgtgaccacctgggaggacgtgccgtacctgggcaagcgggaggaccagtggtgcgggagcctgatcggcctcacgtcccgcgccacctgggcccagaacatcctgaccgcgatccagcaggtccggagcctgatcggggacgaggagttcctcgactacatgccctccatgaagcgcttccggaaggaggaggagagcgagggcgccatctggtga

SEQ ID NO: 10402 - RNA, 9873 nt, synthetic construct
  misc_feature 1..9873: note = derived and/or modified CDS sequence (opt1) from DENV-3__DQ675527__SS-prME
  source 1..9873: mol_type = other RNA
accagcttctgcctgatgatgatgctccccgccaccctggccttccacctgacgtcccgcgacggcgagccgcggatgatcgtggggaagaacgagcgcggcaagagcctcctgttcaagaccgcgtccgggatcaacatgtgcaccctgatcgccatggacctcggcgagatgtgcgacgacaccgtcacgtacaagtgccccctgatcgccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccatcctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgacacccagggggtgaccgtcgagatcacgccccaggccagcaccgtggaggccgtgctgcccgagtacggcaccctggggctcgagtgctccccgcgcaccggcctggacttcaacgagatgatcctgctcaccatgaagaacaaggcgtggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgccatgcacaccgcgctcaccggggccacggagatccagaacagcggcgggacctccatcttcgccggccacctgaagtgccggctgaagatggacaagctcgagctgaagggcatgagctacgccatgtgcctgaacaccttcgtgctcaagaaggaggtctccgagacccagcacgggacgatcctgatcaaggtggagtacaagggcgaggacgccccgtgcaagatccccttcagcaccgaggacgggcagggcaaggcgcacaacggccgcctgatcaccgccaaccccgtggtcaccaagaaggaggagcccgtgaacatcgaggccgagccgcccttcggggagagcaacatcgtgatcggcatcggggacaaggccctgaagatcaactggtacaagaagggctccagcatcgggaagatgttcgaggcgacggcccggggcgcccgccggatggccatcctcggcgacaccgcctgggacttcgggtccgtcggcggggtgctgaacagcctgggcaagatggtgcaccagatcttcgggtccgcgtacaccgccctcttcagcggcgtctcctggatcatgaagatcggcatcggggtgctgctgacctggatcggcctcaacagcaagaacacgtccatgagcttctcctgcatcgtgatcgggatcatcaccctgtacctgggcgccgtcgtgcaggccgacatggggtgcgtgatcaactggaagggcaaggagctcaagtgcggcagcgggatcttcgtcaccaacgaggtgcacacctggacggagcagtacaagttccaggccgactcccccaagcgcctggcgaccgccatcgccggcgcctgggagaacggggtgtgcggcatccgcagcaccacccggatggagaacctgctctggaagcagatcgccaacgagctgaactacatcctgtgggagaacaacatcaagctcacggtcgtggtgggggacatcatcggcgtcctggagcagggcaagcgcaccctgaccccccagccgatggagctcaagtactcctggaagacctgggggaaggcgaagatcgtgacggccgagatccagaacagctccttcatcatcgacggccccaacacccccgagtgccccagcgcctcccgggcctggaacgtgtgggaggtcgaggactacgggttcggcgtgttcaccaccaacatctggctgaagctgcgcgagatgtacacgcagagctgcgaccaccggctcatgagcgcggccatcaaggacgagcgcgccgtgcacgccgacatgggctactggatcgagtcccagaagaacgggagctggaagctggagaaggcctccttcatcgaggtcaagacctgcacctggccgaagagccacaccctgtggtccaacggcgtgctcgagagcgacatgatcatccccaagtccctggcggggcccatcagccagcacaaccaccggccgggctaccacacccagacggccgggccctggcacctgggcaagctcgagctggacttcaactactgcgagggcaccaccgtggtcatcaccgagaactgcgggacgcgcggcccctccctgcggaccaccaccgtgagcgggaagctcatccacgagtggtgctgccgctcctgcacgctgcccccgctgcggtacatgggcgaggacgggtgctggtacggcatggagatccgccccatcaacgagaaggaggagaacatggtgaagagcctcgtctccgccggcagcgggaaggtggacaacttcaccatgggcgtgctgtgcctggccatcctcttcgaggaggtcatgcgggggaagttcggcaagaagcacatgatcgtgggggtgctgttcaccttcgtcctgctcctgtccggccagatcacctggcgcgacatggcccacacgctgatcatgatcggcagcaacgcgtccgaccggatggggatgggcgtgacctacctcgccctgatcgccaccttcaagatccagcccttcctggccctcgggttcttcctgcgcaagctgaccagccgggagaacctcctgctgggcgtgggcctcgccatggcgacgaccctgcagctgcccgaggacatcgagcagatggccaacgggatcgccctcggcctgatgaccctgaagctcatcacccagttcgagacgtaccagctgtggaccgccctggtcagcctcacctgctccaacaccatcttcacgctgaccgtggcgtggcgcaccgccaccctgatcctcgccggggtcagcctgctgccgctctgccagtccagctccatgcggaagacggactggctgcccatgaccgtggccgccatgggcgtgccccccctgccgctcttcatcttcagcctgaaggacacccccaagcgccgctcctggcccctgaacgagggggtcatggcggtgggcctcgtgagcatcctggcctccagcctgctccggaacgacgtccccatggccggcccgctggtggccgggggcctgctcatcgcctgctacgtgatcaccgggacgtccgcggacctgaccgtcgagaaggccgccgacgtgacctgggaggaggaggccgagcagaccggcgtgagccacaacctgatgatcacggtcgacgacgacgggaccatgcgcatcaaggacgacgagaccgagaacatcctcaccgtgctgctgaagaccgccctcctgatcgtgtccggcatcttcccctacagcatccccgcgacgctgctcgtctggcacacctggcagaagcagacccagcggtccggcgtgctgtgggacgtgcccagcccgcccgagacccagaaggccgagctggaggagggggtctaccgcatcaagcagcagggcatcttcgggaagacgcaggtgggcgtgggggtccagaaggagggcgtgttccacaccatgtggcacgtgacccggggcgccgtcctcacccacaacgggaagcgcctggagcccaactgggcctccgtgaagaaggacctgatcagctacggcgggggctggcggctctccgcccagtggcagaagggggaggaggtgcaggtcatcgcggtggagcccggcaagaacccgaagaacttccagacgatgcccggcatcttccagaccaccaccggggagatcggcgccatcgccctggacttcaagcccgggacgagcggcagcccgatcatcaaccgcgagggcaaggtggtcgggctgtacggcaacggggtggtgaccaagaacggcgggtacgtctccggcatcgcccagaccaacgcggagcccgacggccccacccccgagctggaggaggagatgttcaagaagcggaacctcacgatcatggacctgcacccggggagcggcaagacccgcaagtacctgcccgccatcgtgcgggaggccatcaagcgccggctccgcaccctgatcctggcccccacccgggtggtcgccgcggagatggaggaggccctcaaggggctgcccatccgctaccagacgaccgccaccaagtccgagcacaccggccgggagatcgtggacctgatgtgccacgccacgttcaccatgcgcctcctgagcccggtgcgggtccccaactacaacctgatcatcatggacgaggcccacttcaccgaccccgcgtccatcgccgcccgcgggtacatcagcacccgggtgggcatgggcgaggccgccgcgatcttcatgacggccacccccccggggaccgccgaggccttcccccagtccaacgcgcccatccaggacgaggagcgcgacatccccgagcgcagctggaactccggcaacgagtggatcaccgacttcgtggggaagacggtctggttcgtgccgagcatcaaggccggcaacgacatcgccaactgcctccggaagaacgggaagaaggtgatccagctgtcccgcaagaccttcgacaccgagtaccagaagacccggctgaacgactgggacttcgtcgtgacgaccgacatcagcgagatgggcgccaacttcaaggccgaccgcgtgatcgacccccggcgctgcctcaagcccgtcatcctgaccgacggccccgagcgggtgatcctggcggggccgatgcccgtgaccgccgcctccgccgcccagcgccggggccgcgtcgggcggaacccccagaaggagaacgaccagtacatcttcacgggccagcccctcaacaacgacgaggaccacgcgcactggaccgaggccaagatgctgctggacaacatcaacaccccggaggggatcatccccgccctcttcgagcccgagcgcgagaagagcgccgccatcgacggcgagtaccggctgaagggcgagtcccgcaagaccttcgtggagctgatgcggcgcggggacctccccgtctggctggcgcacaaggtggccagcgagggcatcaagtacaccgaccggaagtggtgcttcgacggggagcgcatcaaccagatcctggaggagaacatggacgtggagatctggacgaaggagggcgagcggaagaacctccgcccgcgctggctggacgcccggacctactccgaccccctggccctcaaggagttcaaggacttcgcggccggccgcaagagcatcgccctggacctggtcaccgagatcgggcgggtgccctcccacctcgcccaccgcacccggaacgccctggacaacctggtgatgctccacacgagcgagcacggcgggcgcgcgtaccggcacgccgtcgaggagctgccggagaccatggagaccctgctcctgctgggcctcatgatcctgctgaccgggggcgccatgctcttcctgatcagcggcaaggggatcggcaagacgtccatcgggctgatctgcgtgatcgtgagctccggcatgctctggatggccgacgtccccctgcagtggatcgccagcgcgatcgtgctggagttcttcatgatggtgctcctgatccccgagcccgagaagcagcgcaccccgcaggacaaccagctggcctacgtcgtgatcgggatcctcaccctggccgccatcgtggccgcgaacgagatgggcctgctcgagaccacgaagcgggacctgggcatgtccaaggagcccggggtcgtgagccccacctcctacctggacgtggacctccaccccgccagcgcctggaccctgtacgccgtcgccaccacggtgatcaccccgatgctgcgccacaccatcgagaactccaccgcgaacgtgagcctcgccgccatcgccaaccaggcggtcgtgctgatgggcctggacaaggggtggcccatctccaagatggacctcggcgtgcccctgctggccctcgggtgctacagccaggtcaaccccctgacgctgaccgccgccgtgctcctgctggtgacccactacgccatcatcggcccgggcctccaggcgaaggccacccgggaggcccagaagcgcacggccgccgggatcatgaagaaccccaccgtcgacggcatcatgaccatcgacctggaccccgtgatctacgactccaagttcgagaagcagctggggcaggtgatgctcctggtcctgtgcgcggtgcagctcctgctgatgcggaccagctgggccctctgcgaggccctgacgctggccaccggccccatcaccaccctctgggagggctccccggggaagttctggaacacgaccatcgccgtgagcatggcgaacatcttccgcggctcctacctggccggggccggcctggccttcagcatcatgaagtccgtcgggaccggccggcgcggcaccgggagccagggcgagacgctcggggagaagtggaagaagaagctgaaccagctgagccggaaggagttcgacctctacaagaagtccggcatcaccgaggtggaccgcaccgaggcgaaggaggggctgaagcggggcgagaccacccaccacgccgtgagccgcggctccgccaagctgcagtggttcgtcgagcggaacatggtgatccccgaggggcgcgtgatcgacctcggctgcgggcgcggcgggtggagctactactgcgccggcctgaagaaggtcacggaggtgcggggctacaccaaggggggccccgggcacgaggagcccgtgccgatgtccacctacggctggaacatcgtcaagctgatgagcgggaaggacgtgttctacctcccccccgagaagtgcgacaccctgctgtgcgacatcggcgagtccagcccctccccgacggtggaggagagccgcaccatccgggtcctgaagatggtggagccctggctcaagaacaaccagttctgcatcaaggtgctgaacccctacatgcccaccgtcatcgagcacctggagcgcctccagcggaagtacggcgggatgctggtgcgcaacccgctgtcccggaacagcacccacgagatgtactggatctccaacggcacggggaacatcgtgagctccgtcaacatggtgagccgcctcctgctgaaccggttcaccatgacccaccgccggcccaccatcgagaaggacgtcgacctcggcgccggcacgcgccacgtgaacgcggagcccgagaccccgaacatggacgtgatcggggagcggatcaagcgcatcaaggaggagcactccagcacctggcactacgacgacgagaacccctacaagacctgggcctaccacggctcctacgaggtcaaggccacggggagcgccagctccatgatcaacggcgtggtgaagctgctgaccaagccctgggacgtcgtgcccatggtgacccagatggccatgaccgacacgaccccgttcgggcagcagcgggtcttcaaggagaaggtggacacccgcaccccccggcccatgcccggcacgcgcaaggtgatggagatcaccgcggagtggctctggcggaccctgggccgcaacaagaagccgcgcctgtgcacccgggaggagttcacgaagaaggtccgcaccaacgccgccatgggggccgtgttcaccgaggagaaccagtgggacagcgcccgggcggccgtggaggacgaggagttctggaagctcgtcgaccgcgagcgggagctgcacaagctgggcaagtgcgggtcctgcgtgtacaacatgatgggcaagcgcgagaagaagctcggggagttcggcaaggccaagggcagccgggccatctggtacatgtggctgggggcgcgctacctggagttcgaggccctcggcttcctgaacgaggaccactggttctcccgggagaacagctactccggggtggagggcgaggggctgcacaagctcggctacatcctgcgcgacatcagcaagatccccggcggggccatgtacgccgacgacaccgccggctgggacacgcggatcaccgaggacgacctgcacaacgaggagaagatcacccagcagatggaccccgagcaccgccagctcgcgtccgccatcttcaagctgacctaccagaacaaggtcgtgaaggtgcagcggcccacgccgaaggggaccgtcatggacatcatcagccgcaaggaccagcggggctccggccaggtggggacctacggcctgaacaccttcaccaacatggaggcccagctcgtgcgccagatggagggggagggcgtcctgagcaaggccgacctggagaacccccacctcctggagaagaagatcacgcagtggctggagaccaagggggtggagcggctcaagcgcatggccatctccggcgacgactgcgtggtcaagcccatcgacgaccggttcgcgaacgccctgctggccctcaacgacatgggcaaggtgcgcaaggacatcccccagtggcagccgagcaaggggtggcacgactggcagcaggtgcccttctgctcccaccacttccacgagctgatcatgaaggacggccggaagctggtcgtgccctgccgcccccaggacgagctcatcgggcgcgcccggatcagccagggcgccgggtggtccctgaaggagaccgcgtgcctgggcaaggcctacgcccagatgtggagcctcatgtacttccaccgccgggacctgcgcctggcctccaacgccatctgcagcgcggtgccggtccactgggtgcccaccagccggacgacctggtccatccacgcccaccaccagtggatgaccaccgaggacatgctcacggtgtggaaccgcgtctggatcgaggacaacccctggatggaggacaagacccccgtgaccacctgggaggacgtgccgtacctgggcaagcgggaggaccagtggtgcgggagcctgatcggcctcacgtcccgcgccacctgggcccagaacatcctgaccgcgatccagcaggtccggagcctgatcggggacgaggagttcctcgactacatgccctccatgaagcgcttccggaaggaggaggagagcgagggcgccatctggtga

SEQ ID NO: 10403 - RNA, 9873 nt, synthetic construct
  misc_feature 1..9873: note = derived and/or modified CDS sequence (opt1) from DENV-3__DQ675528__SS-prME
  source 1..9873: mol_type = other RNA
accagcttctgcctgatgatgatgctccccgccaccctggccttccacctgacgtcccgcgacggcgagccgcggatgatcgtggggaagaacgagcgcggcaagagcctcctgttcaagaccgcgtccgggatcaacatgtgcaccctgatcgccatggacctcggcgagatgtgcgacgacaccgtcacgtacaagtgccccctgatcgccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccatcctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgacacccagggggtgaccgtcgagatcacgccccaggccagcaccgtggaggccgtgctgcccgagtacggcaccctggggctcgagtgctccccgcgcaccggcctggacttcaacgagatgatcctgctcaccatgaagaacaaggcgtggatggtccaccggcagtggttcttcgacctgcccctgccctggacgagcggcgccaccaccgagacccccacgtggaaccgcaaggagctcctggtgaccttcaagaacgcccacgccaagaagcaggaggtggtcgtgctggggtcccaggagggcgccatgcacaccgtgctcaccggggcgacggagatccagaacagcggcgggacctccatcttcgccggccacctgaagtgccggctgaagatggacaagctcgagctgaagggcatgagctacgccatgtgcctgaacaccttcgtcctcaagaaggaggtgtccgagacccagcacgggacgatcctgatcaaggtggagtacaagggcgaggacgccccgtgcaagatccccttcagcaccgaggacgggcagggcaaggcccacaacggccgcctgatcaccgcgaaccccgtcgtgaccaagaaggaggagcccgtgaacatcgaggccgagccgcccttcggggagagcaacatcgtcatcggcatcggggacaaggccctgaagatcaactggtacaagaagggctccagcatcgggaagatgttcgaggccacggcgcggggcgcccgccggatggccatcctcggcgacaccgcctgggacttcgggtccgtgggcggggtgctgaacagcctgggcaagatggtccaccagatcttcgggtccgcctacaccgcgctcttcagcggcgtgtcctggatcatgaagatcggcatcggggtgctgctgacctggatcggcctcaacagcaagaacacgtccatgagcttctcctgcatcgtcatcgggatcatcaccctgtacctgggcgccgtggtgcaggccgacatggggtgcgtcatcaactggaagggcaaggagctcaagtgcggcagcgggatcttcgtgaccaacgaggtgcacacctggacggagcagtacaagttccaggccgactcccccaagcgcctggccaccgcgatcgccggcgcctgggagaacggggtctgcggcatccgcagcaccacccggatggagaacctgctctggaagcagatcgccaacgagctgaactacatcctgtgggagaacaacatcaagctcacggtggtggtcggggacatcatcggcgtgctggagcagggcaagcgcaccctgaccccccagccgatggagctcaagtactcctggaagacctgggggaaggccaagatcgtgacggcggagatccagaacagctccttcatcatcgacggccccaacacccccgagtgccccagcgcctcccgggcctggaacgtctgggaggtggaggactacgggttcggcgtgttcaccaccaacatctggctgaagctgcgcgagatgtacacgcagagctgcgaccaccggctcatgagcgccgcgatcaaggacgagcgcgccgtccacgccgacatgggctactggatcgagtcccagaagaacgggagctggaagctggagaaggcctccttcatcgaggtgaagacctgcacctggccgaagagccacaccctgtggtccaacggcgtgctcgagagcgacatgatcatccccaagtccctggccgggcccatcagccagcacaaccaccggccgggctaccacacccagacggcggggccctggcacctgggcaagctcgagctggacttcaactactgcgagggcaccaccgtcgtgatcaccgagaactgcgggacgcgcggcccctccctgcggaccaccaccgtgagcgggaagctcatccacgagtggtgctgccgctcctgcacgctgcccccgctgcggtacatgggcgaggacgggtgctggtacggcatggagatccgccccatcaacgagaaggaggagaacatggtcaagagcctcgtgtccgccggcagcgggaaggtggacaacttcaccatgggcgtcctgtgcctggccatcctcttcgaggaggtgatgcgggggaagttcggcaagaagcacatgatcgtgggggtcctgttcaccttcgtgctgctcctgtccggccagatcacctggcgcgacatggcccacacgctgatcatgatcggcagcaacgcctccgaccggatggggatgggcgtgacctacctcgcgctgatcgccaccttcaagatccagcccttcctggccctcgggttcttcctgcgcaagctgaccagccgggagaacctcctgctgggcgtcggcctcgccatggccacgaccctgcagctgcccgaggacatcgagcagatggcgaacgggatcgccctcggcctgatgaccctgaagctcatcacccagttcgagacgtaccagctgtggaccgccctggtgagcctcacctgctccaacaccatcttcacgctgaccgtcgcctggcgcaccgcgaccctgatcctcgccggggtgagcctgctgccgctctgccagtccagctccatgcggaagacggactggctgcccatgaccgtggccgccatgggcgtcccccccctgccgctcttcatcttcagcctgaaggacacccccaagcgccgctcctggcccctgaacgagggggtgatggccgtgggcctcgtcagcatcctggcgtccagcctgctccggaacgacgtgcccatggccggcccgctggtggccgggggcctgctcatcgcctgctacgtcatcaccgggacgtccgccgacctgaccgtggagaaggcggccgacgtgacctgggaggaggaggccgagcagaccggcgtcagccacaacctgatgatcacggtggacgacgacgggaccatgcgcatcaaggacgacgagaccgagaacatcctcaccgtgctgctgaagaccgccctcctgatcgtctccggcatcttcccctacagcatccccgccacgctgctcgtgtggcacacctggcagaagcagacccagcggtccggcgtgctgtgggacgtccccagcccgcccgagacccagaaggcggagctggaggagggggtgtaccgcatcaagcagcagggcatcttcgggaagacgcaggtgggcgtcggggtgcagaaggagggcgtgttccacaccatgtggcacgtcacccggggcgccgtgctcacccacaacgggaagcgcctggagcccaactgggcctccgtgaagaaggacctgatcagctacggcgggggctggcggctctccgcccagtggcagaagggggaggaggtccaggtgatcgccgtggagcccggcaagaacccgaagaacttccagacgatgcccggcatcttccagaccaccaccggggagatcggcgcgatcgccctggacttcaagcccgggacgagcggcagcccgatcatcaaccgcgagggcaaggtcgtggggctgtacggcaacggggtggtcaccaagaacggcgggtacgtgtccggcatcgcccagaccaacgccgagcccgacggccccacccccgagctggaggaggagatgttcaagaagcggaacctcacgatcatggacctgcacccggggagcggcaagacccgcaagtacctgcccgcgatcgtgcgggaggccatcaagcgccggctccgcaccctgatcctggcccccacccgggtcgtggccgccgagatggaggaggcgctcaaggggctgcccatccgctaccagacgaccgccaccaagtccgagcacaccggccgggagatcgtggacctgatgtgccacgccacgttcaccatgcgcctcctgagcccggtccgggtgcccaactacaacctgatcatcatggacgaggcccacttcaccgaccccgcctccatcgcggcccgcgggtacatcagcacccgggtgggcatgggcgaggccgccgccatcttcatgacggcgacccccccggggaccgccgaggccttcccccagtccaacgcccccatccaggacgaggagcgcgacatccccgagcgcagctggaactccggcaacgagtggatcaccgacttcgtcgggaagacggtgtggttcgtgccgagcatcaaggcgggcaacgacatcgccaactgcctccggaagaacgggaagaaggtcatccagctgtcccgcaagaccttcgacaccgagtaccagaagacccggctgaacgactgggacttcgtggtgacgaccgacatcagcgagatgggcgccaacttcaaggccgaccgcgtcatcgacccccggcgctgcctcaagcccgtgatcctgaccgacggccccgagcgggtgatcctggccgggccgatgcccgtcaccgcggcctccgccgcccagcgccggggccgcgtggggcggaacccccagaaggagaacgaccagtacatcttcacgggccagcccctcaacaacgacgaggaccacgcccactggaccgaggcgaagatgctgctggacaacatcaacaccccggaggggatcatccccgccctcttcgagcccgagcgcgagaagagcgccgccatcgacggcgagtaccggctgaagggcgagtcccgcaagaccttcgtcgagctgatgcggcgcggggacctccccgtgtggctggcccacaaggtggcgagcgagggcatcaagtacaccgaccggaagtggtgcttcgacggggagcgcaacaaccagatcctggaggagaacatggacgtcgagatctggacgaaggagggcgagcggaagaagctccgcccgcgctggctggacgcccggacctactccgaccccctggccctcaaggagttcaaggacttcgccgcgggccgcaagagcatcgccctggacctggtgaccgagatcgggcgggtgccctcccacctcgcccaccgcacccggaacgccctggacaacctggtcatgctccacacgagcgagcacggcgggcgcgcctaccggcacgcggtggaggagctgccggagaccatggagaccctgctcctgctgggcctcatgatcctgctgaccgggggcgccatgctcttcctgatcagcggcaaggggatcggcaagacgtccatcgggctgatctgcgtgatcgtcagctccggcatgctctggatggccgacgtgcccctgcagtggatcgccagcgccatcgtgctggagttcttcatgatggtcctcctgatccccgagcccgagaagcagcgcaccccgcaggacaaccagctggcgtacgtggtgatcgggatcctcaccctggccgccatcgtcgccgccaacgagatgggcctgctcgagaccacgaagcgggacctgggcatgtccaaggagcccggggtggtgagccccacctcctacctggacgtcgacctccaccccgcgagcgcctggaccctgtacgccgtggccaccacggtgatcaccccgatgctgcgccacaccatcgagaactccaccgccaacgtcagcctcgcggccatcgccaaccaggccgtggtgctgatgggcctggacaaggggtggcccatctccaagatggacctcggcgtccccctgctggcgctcgggtgctacagccaggtgaaccccctgacgctgaccgccgccgtgctcctgctggtcacccactacgccatcatcggcccgggcctccaggccaaggcgacccgggaggcccagaagcgcacggccgccgggatcatgaagaaccccaccgtggacggcatcatgaccatcgacctggaccccgtgatctacgactccaagttcgagaagcagctggggcaggtcatgctcctggtgctgtgcgccgtgcagctcctgctgatgcggaccagctgggcgctctgcgaggccctgacgctggccaccggccccatcaccaccctctgggagggctccccggggaagttctggaacacgaccatcgccgtcagcatggccaacatcttccgcggctcctacctggcgggggccggcctggccttcagcatcatgaagtccgtggggaccggccggcgcggcaccgggagccagggcgagacgctcggggagaagtggaagaagaagctgaaccagctgagccggaaggagttcgacctctacaagaagtccggcatcaccgaggtggaccgcaccgaggccaaggaggggctgaagcggggcgagaccacccaccacgcggtcagccgcggctccgccaagctgcagtggttcgtggagcggaacatggtgatccccgaggggcgcgtcatcgacctcggctgcgggcgcggcgggtggagctactactgcgccggcctgaagaaggtgacggaggtgcggggctacaccaaggggggccccgggcacgaggagcccgtcccgatgtccacctacggctggaacatcgtgaagctgatgagcgggaaggacgtgttctacctcccccccgagaagtgcgacaccctgctgtgcgacatcggcgagtccagcccctccccgacggtcgaggagagccgcaccatccgggtgctgaagatggtggagccctggctcaagaacaaccagttctgcatcaaggtcctgaacccctacatgcccaccgtgatcgagcacctggagcgcctccagcggaagtacggcgggatgctggtgcgcaacccgctgtcccggaacagcacccacgagatgtactggatctccaacggcacggggaacatcgtcagctccgtgaacatggtcagccgcctcctgctgaaccggttcaccatgacccaccgccggcccaccatcgagaaggacgtggacctcggcgccggcacgcgccacgtgaacgccgagcccgagaccccgaacatggacgtcatcggggagcggatcaagcgcatcaaggaggagcactccagcacctggcactacgacgacgagaacccctacaagacctgggcgtaccacggctcctacgaggtgaaggccacggggagcgccagctccatgatcaacggcgtggtcaagctgctgaccaagccctgggacgtggtgcccatggtcacccagatggccatgaccgacacgaccccgttcgggcagcagcgggtgttcaaggagaaggtggacacccgcaccccccggcccatgcccggcacgcgcaaggtcatggagatcaccgccgagtggctctggcggaccctgggccgcaacaagaagccgcgcctgtgcacccgggaggagttcacgaagaaggtgcgcaccaacgcggccatgggggccgtgttcaccgaggagaaccagtgggacagcgcccgggccgcggtcgaggacgaggagttctggaagctcgtggaccgcgagcgggagctgcacaagctgggcaagtgcgggtcctgcgtgtacaacatgatgggcaagcgcgagaagaagctcggggagttcggcaaggccaagggcagccgggccatctggtacatgtggctgggggcccgctacctggagttcgaggcgctcggcttcctgaacgaggaccactggttctcccgggagaacagctactccggggtcgagggcgaggggctgcacaagctcggctacatcctgcgcgacatcagcaagatccccggcggggccatgtacgccgacgacaccgccggctgggacacgcggatcaccgaggacgacctgcacaacgaggagaagatcacccagcagatggaccccgagcaccgccagctcgcctccgcgatcttcaagctgacctaccagaacaaggtggtgaaggtccagcggcccacgccgaaggggaccgtgatggacatcatcagccgcaaggaccagcggggctccggccaggtggggacctacggcctgaacaccttcaccaacatggaggcccagctcgtccgccagatggagggggagggcgtgctgagcaaggccgacctggagaacccccacctcctggagaagaagatcacgcagtggctggagaccaagggggtggagcggctcaagcgcatggccatctccggcgacgactgcgtcgtgaagcccatcgacgaccggttcgccaacgcgctgctggccctcaacgacatgggcaaggtgcgcaaggacatcccccagtggcagccgagcaaggggtggcacgactggcagcaggtccccttctgctcccaccacttccacgagctgatcatgaaggacggccggaagctggtggtgccctgccgcccccaggacgagctcatcgggcgcgcccggatcagccagggcgccgggtggtccctgaaggagaccgcctgcctgggcaaggcgtacgcccagatgtggagcctcatgtacttccaccgccgggacctgcgcctggcctccaacgccatctgcagcgccgtcccggtgcactgggtgcccaccagccggacgacctggtccatccacgcgcaccaccagtggatgaccaccgaggacatgctcacggtctggaaccgcgtgtggatcgaggacaacccctggatggaggacaagacccccgtgaccacctgggaggacgtcccgtacctgggcaagcgggaggaccagtggtgcgggagcctgatcggcctcacgtcccgcgccacctgggcccagaacatcctgaccgccatccagcaggtgcggagcctgatcggggacgaggagttcctcgactacatgccctccatgaagcgcttccggaaggaggaggagagcgagggcgcgatctggtga

SEQ ID NO: 10404 - RNA, 9873 nt, synthetic construct
  misc_feature 1..9873: note = derived and/or modified CDS sequence (opt1) from DENV-3__DQ675530__SS-prME
  source 1..9873: mol_type = other RNA
accagcttctgcctgatgatgatgctccccgccaccctggccttccacctgacgtcccgcgacggcgagccgcggatgatcgtggggaagaacgagcgcggcaagagcctcctgttcaagaccgcgtccgggatcaacatgtgcaccctgatcgccatggacctcggcgagatgtgcgacgacaccgtcacgtacaagtgccccctgatcgccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctcccccacccagaaggtggtgatcttcatcctcctgatgctggtcacgcccagcatgaccatgcggtgcgtgggggtgggcaaccgcgacttcgtcgagggcctctccggggccacctgggtggacgtggtcctggagcacggcgggtgcgtgaccacgatggccaagaacaagcccaccctggacatcgagctccagaagaccgaggccacccagctggcgacgctgcggaagctctgcatcgagggcaagatcaccaacatcaccaccgacagccgctgcccgacgcagggcgaggccatcctgcccgaggagcaggaccagaactacgtgtgcaagcacacctacgtcgaccgggggtggggcaacgggtgcggcctgttcgggaagggctccctcgtgacctgcgccaagttccagtgcctggagcccatcgagggcaaggtggtccagtacgagaacctgaagtacaccgtgatcatcacggtgcacaccggggaccagcaccaggtcggcaacgacacccagggggtgaccgtcgagatcacgccccaggccagcaccgtggaggccgtgctcccggagtacggcaccctggggctggagtgctccccccgcaccggcctcgacttcaacgagatgatcctgctgaccatgaagaacaaggcgtggatggtccaccggcagtggttcttcgacctccccctgccctggacgagcggcgccaccaccgagaccccgacgtggaaccgcaaggagctgctcgtgaccttcaagaacgcccacgccaagaagcaggaggtggtcgtgctggggtcccaggagggcgccatgcacaccgcgctgaccggggccacggagatccagaacagcggcgggacctccatcttcgccggccacctcaagtgccggctgaagatggacaagctggagctcaagggcatgagctacgccatgtgcctgaacaccttcgtgctgaagaaggaggtctccgagacccagcacgggacgatcctcatcaaggtggagtacaagggcgaggacgccccctgcaagatccccttcagcaccgaggacgggcagggcaaggcgcacaacggccgcctgatcaccgccaaccccgtggtcaccaagaaggaggagccggtgaacatcgaggccgagccccccttcggggagagcaacatcgtgatcggcatcggggacaaggccctgaagatcaactggtacaagaagggctccagcatcgggaagatgttcgaggcgacggcccggggcgcccgccggatggccatcctgggcgacaccgcctgggacttcgggtccgtcggcggggtgctcaacagcctgggcaagatggtgcaccagatcttcgggtccgcgtacaccgccctgttcagcggcgtctcctggatcatgaagatcggcatcggggtgctcctgacctggatcggcctgaacagcaagaacacgtccatgagcttctcctgcatcgtgatcgggatcatcaccctctacctgggcgccgtcgtgcaggccgacatggggtgcgtgatcaactggaagggcaaggagctgaagtgcggcagcgggatcttcgtcaccaacgaggtgcacacctggacggagcagtacaagttccaggccgactcccccaagcgcctcgcgaccgccatcgccggcgcctgggagaacggggtgtgcggcatccgcagcaccacccggatggagaacctgctgtggaagcagatcgccaacgagctcaactacatcctgtgggagaacaacatcaagctgacggtcgtggtgggggacatcatcggcgtcctcgagcagggcaagcgcaccctgaccccgcagcccatggagctgaagtactcctggaagacctgggggaaggcgaagatcgtgacggccgagatccagaacagctccttcatcatcgacggccccaacacccccgagtgcccgagcgcctcccgggcctggaacgtgtgggaggtcgaggactacgggttcggcgtgttcaccaccaacatctggctcaagctgcgcgagatgtacacgcagagctgcgaccaccggctgatgagcgcggccatcaaggacgagcgcgccgtgcacgccgacatgggctactggatcgagtcccagaagaacgggagctggaagctcgagaaggcctccttcatcgaggtcaagacctgcacctggcccaagagccacaccctgtggtccaacggcgtgctggagagcgacatgatcatccccaagtccctcgcggggccgatcagccagcacaaccaccggcccggctaccacacccagacggccgggccctggcacctgggcaagctggagctcgacttcaactactgcgagggcaccaccgtggtcatcaccgagaactgcgggacgcgcggcccctccctgcggaccaccaccgtgagcgggaagctgatccacgagtggtgctgccgctcctgcacgctcccgcccctgcggtacatgggcgaggacgggtgctggtacggcatggagatccgccccatcaacgagaaggaggagaacatggtgaagagcctggtctccgccggcagcgggaaggtggacaacttcaccatgggcgtgctctgcctggccatcctgttcgaggaggtcatgcgggggaagttcggcaagaagcacatgatcgtgggggtgctcttcaccttcgtcctgctgctctccggccagatcacctggcgcgacatggcccacacgctgatcatgatcggcagcaacgcgtccgaccggatggggatgggcgtgacctacctggccctcatcgccaccttcaagatccagcccttcctggccctggggttcttcctccgcaagctgaccagccgggagaacctgctcctgggcgtgggcctggccatggcgacgaccctccagctgccggaggacatcgagcagatggccaacgggatcgccctgggcctcatgaccctgaagctgatcacccagttcgagacgtaccagctctggaccgccctggtcagcctgacctgctccaacaccatcttcacgctcaccgtggcgtggcgcaccgccaccctgatcctggccggggtcagcctcctgcccctgtgccagtccagctccatgcggaagacggactggctccccatgaccgtggccgccatgggcgtgcccccgctgcccctgttcatcttcagcctcaaggacacccccaagcgccgctcctggcccctgaacgagggggtcatggcggtgggcctggtgagcatcctcgcctccagcctgctgcggaacgacgtcccgatggccggccccctcgtggccgggggcctgctgatcgcctgctacgtgatcaccgggacgtccgcggacctcaccgtcgagaaggccgccgacgtgacctgggaggaggaggccgagcagaccggcgtgagccacaacctgatgatcacggtcgacgacgacgggaccatgcgcatcaaggacgacgagaccgagaacatcctgaccgtgctcctgaagaccgccctgctcatcgtgtccggcatcttcccctacagcatccccgcgacgctgctggtctggcacacctggcagaagcagacccagcggtccggcgtgctctgggacgtgccgagcccccccgagacccagaaggccgagctggaggagggggtctaccgcatcaagcagcagggcatcttcgggaagacgcaggtgggcgtgggggtccagaaggagggcgtgttccacaccatgtggcacgtgacccggggcgccgtcctgacccacaacgggaagcgcctcgagcccaactgggcctccgtgaagaaggacctgatcagctacggcgggggctggcggctgtccgcccagtggcagaagggggaggaggtgcaggtcatcgcggtggagccgggcaagaaccccaagaacttccagacgatgcccggcatcttccagaccaccaccggggagatcggcgccatcgccctcgacttcaagccggggacgagcggcagccccatcatcaaccgcgagggcaaggtggtcgggctgtacggcaacggggtggtgaccaagaacggcgggtacgtctccggcatcgcccagaccaacgcggagcccgacggccccaccccggagctggaggaggagatgttcaagaagcggaacctgacgatcatggacctccaccccgggagcggcaagacccgcaagtacctgcccgccatcgtgcgggaggccatcaagcgccggctgcgcaccctcatcctggcccccacccgggtggtcgccgcggagatggaggaggccctgaaggggctcccgatccgctaccagacgaccgccaccaagtccgagcacaccggccgggagatcgtggacctgatgtgccacgccacgttcaccatgcgcctgctcagccccgtgcgggtccccaactacaacctgatcatcatggacgaggcccacttcaccgaccccgcgtccatcgccgcccgcgggtacatcagcacccgggtgggcatgggcgaggccgccgcgatcttcatgacggccaccccgcccgggaccgccgaggccttcccccagtccaacgcgcccatccaggacgaggagcgcgacatcccggagcgcagctggaactccggcaacgagtggatcaccgacttcgtggggaagacggtctggttcgtgcccagcatcaaggccggcaacgacatcgccaactgcctgcggaagaacgggaagaaggtgatccagctctcccgcaagaccttcgacaccgagtaccagaagacccggctgaacgactgggacttcgtcgtgacgaccgacatcagcgagatgggcgccaacttcaaggccgaccgcgtgatcgacccccggcgctgcctgaagcccgtcatcctcaccgacggcccggagcgggtgatcctggcggggcccatgcccgtgaccgccgcctccgccgcccagcgccggggccgcgtcgggcggaacccccagaaggagaacgaccagtacatcttcacgggccagccgctgaacaacgacgaggaccacgcgcactggaccgaggccaagatgctcctggacaacatcaacacccccgaggggatcatccccgccctgttcgagcccgagcgcgagaagagcgccgccatcgacggcgagtaccggctcaagggcgagtcccgcaagaccttcgtggagctgatgcggcgcggggacctgccggtctggctcgcgcacaaggtggccagcgagggcatcaagtacaccgaccggaagtggtgcttcgacggggagcgcaacaaccagatcctggaggagaacatggacgtggagatctggacgaaggagggcgagcggaagaagctgcgcccccgctggctcgacgcccggacctactccgaccccctggccctgaaggagttcaaggacttcgcggccggccgcaagagcatcgccctcgacctggtcaccgagatcgggcgggtgccgtcccacctggcccaccgcacccggaacgccctcgacaacctggtgatgctgcacacgagcgagcacggcgggcgcgcgtaccggcacgccgtcgaggagctccccgagaccatggagaccctgctgctcctgggcctgatgatcctcctgaccgggggcgccatgctgttcctcatcagcggcaaggggatcggcaagacgtccatcgggctgatctgcgtgatcgtgagctccggcatgctgtggatggccgacgtccccctccagtggatcgccagcgcgatcgtgctggagttcttcatgatggtgctgctcatccccgagccggagaagcagcgcaccccccaggacaaccagctggcctacgtcgtgatcgggatcctgaccctcgccgccatcgtggccgcgaacgagatgggcctgctggagaccacgaagcgggacctcggcatgtccaaggagcccggggtcgtgagccccacctcctacctggacgtggacctgcacccggccagcgcctggaccctctacgccgtcgccaccacggtgatcacccccatgctgcgccacaccatcgagaactccaccgcgaacgtgagcctggccgccatcgccaaccaggcggtcgtgctcatgggcctggacaaggggtggcccatctccaagatggacctgggcgtgcccctcctggccctggggtgctacagccaggtcaacccgctcacgctgaccgccgccgtgctgctcctggtgacccactacgccatcatcggccccggcctgcaggcgaaggccacccgggaggcccagaagcgcacggccgccgggatcatgaagaaccccaccgtcgacggcatcatgaccatcgacctcgaccccgtgatctacgactccaagttcgagaagcagctggggcaggtgatgctgctcgtcctgtgcgcggtgcagctgctcctgatgcggaccagctgggccctgtgcgaggccctcacgctggccaccggcccgatcaccaccctgtgggagggctcccccgggaagttctggaacacgaccatcgccgtgagcatggcgaacatcttccgcggctcctacctcgccggggccggcctggccttcagcatcatgaagtccgtcgggaccggccggcgcggcaccgggagccagggcgagacgctgggggagaagtggaagaagaagctcaaccagctgagccggaaggagttcgacctgtacaagaagtccggcatcaccgaggtggaccgcaccgaggcgaaggaggggctcaagcggggcgagaccacccaccacgccgtgagccgcggctccgccaagctgcagtggttcgtcgagcggaacatggtgatccccgaggggcgcgtgatcgacctgggctgcgggcgcggcgggtggagctactactgcgccggcctcaagaaggtcacggaggtgcggggctacaccaaggggggccccgggcacgaggagccggtgcccatgtccacctacggctggaacatcgtcaagctgatgagcgggaaggacgtgttctacctgccccccgagaagtgcgacaccctcctgtgcgacatcggcgagtccagcccgtcccccacggtggaggagagccgcaccatccgggtcctgaagatggtggagccctggctgaagaacaaccagttctgcatcaaggtgctcaacccctacatgccgaccgtcatcgagcacctggagcgcctgcagcggaagtacggcgggatgctcgtgcgcaaccccctgtcccggaacagcacccacgagatgtactggatctccaacggcacggggaacatcgtgagctccgtcaacatggtgagccgcctgctcctgaaccggttcaccatgacccaccgccggcccaccatcgagaaggacgtcgacctgggcgccggcacgcgccacgtgaacgcggagccggagacccccaacatggacgtgatcggggagcggatcaagcgcatcaaggaggagcactccagcacctggcactacgacgacgagaacccctacaagacctgggcctaccacggctcctacgaggtcaaggccacggggagcgccagctccatgatcaacggcgtggtgaagctcctgaccaagccctgggacgtcgtgccgatggtgacccagatggccatgaccgacacgacccccttcgggcagcagcgggtcttcaaggagaaggtggacacccgcaccccccggcccatgccgggcacgcgcaaggtgatggagatcaccgcggagtggctgtggcggaccctcggccgcaacaagaagccccgcctgtgcacccgggaggagttcacgaagaaggtccgcaccaacgccgccatgggggccgtgttcaccgaggagaaccagtgggacagcgcccgggcggccgtggaggacgaggagttctggaagctggtcgaccgcgagcgggagctccacaagctgggcaagtgcgggtcctgcgtgtacaacatgatgggcaagcgcgagaagaagctgggggagttcggcaaggccaagggcagccgggccatctggtacatgtggctcggggcgcgctacctggagttcgaggccctgggcttcctcaacgaggaccactggttctcccgggagaacagctactccggggtggagggcgaggggctgcacaagctgggctacatcctccgcgacatcagcaagatccccggcggggccatgtacgccgacgacaccgccggctgggacacgcggatcaccgaggacgacctgcacaacgaggagaagatcacccagcagatggaccccgagcaccgccagctggcgtccgccatcttcaagctcacctaccagaacaaggtcgtgaaggtgcagcggccgacgcccaaggggaccgtcatggacatcatcagccgcaaggaccagcggggctccggccaggtggggacctacggcctgaacaccttcaccaacatggaggcccagctggtgcgccagatggagggggagggcgtcctcagcaaggccgacctggagaacccccacctgctcgagaagaagatcacgcagtggctggagaccaagggggtggagcggctgaagcgcatggccatctccggcgacgactgcgtggtcaagcccatcgacgaccggttcgcgaacgccctcctggccctgaacgacatgggcaaggtgcgcaaggacatcccgcagtggcagcccagcaaggggtggcacgactggcagcaggtgcccttctgctcccaccacttccacgagctcatcatgaaggacggccggaagctggtcgtgccctgccgcccgcaggacgagctgatcgggcgcgcccggatcagccagggcgccgggtggtccctcaaggagaccgcgtgcctgggcaaggcctacgcccagatgtggagcctgatgtacttccaccgccgggacctccgcctggcctccaacgccatctgcagcgcggtgcccgtccactgggtgcccaccagccggacgacctggtccatccacgcccaccaccagtggatgaccaccgaggacatgctgacggtgtggaaccgcgtctggatcgaggacaacccctggatggaggacaagaccccggtgaccacctgggaggacgtgccctacctcggcaagcgggaggaccagtggtgcgggagcctgatcggcctgacgtcccgcgccacctgggcccagaacatcctcaccgcgatccagcaggtccggagcctgatcggggacgaggagttcctggactacatgccctccatgaagcgcttccggaaggaggaggagagcgagggcgccatctggtga

SEQ ID NO: 10405 - RNA, 9873 nt, synthetic construct
  misc_feature 1..9873: note = derived and/or modified CDS sequence (opt1) from DENV-3__DQ675533__SS-prME
  source 1..9873: mol_type = other RNA
accagcctgtgcctgatgatgatcctgcccgccgccctggcgttccacctcaccagccgggacggggagccccggatgatcgtggggaagaacgagcggggcaagagcctgctgttcaagaccgccagcgggatcaacatgtgcaccctcatcgccatggacctgggcgagatgtgcgacgacaccgtgacctacaagtgcccccacatcaccgaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccgtgctgccggaggagcaggaccagaactacgtctgcaagcacacctacgtggaccgggggtggggcaacgggtgcggcctcttcgggaagggctccctggtgacctgcgccaagttccagtgcctggagcccatcgagggcaaggtcgtgcagtacgagaacctcaagtacaccgtgatcatcacggtccacaccggggaccagcaccaggtgggcaacgagacccagggggtcaccgccgagatcacgccccaggccagcacccacgaggcgctgctgcccgagtacggcaccctcgggctggagtgctccccgcgcaccggcctggacttcaacgagatgatcctcctgaccatgaagaacaaggcctggatggtgcaccggcagtggttcttcgacctgcccctcccctgggccagcggcgccacgaccgagacccccacctggaaccgcaaggagctgctggtgacgttcaagaacgcccacgcgaagaagcaggaggtcgtggtgctcgggtcccaggagggcgccatgcacaccgccctgaccggggccaccgagatccagaacagcggcgggacgtccatcttcgccggccacctgaagtgccggctcaagatggacaagctggagctgaagggcatgagctacgcgatgtgcaccaacaccttcgtcctcaagaaggaggtgtccgagacccagcacgggacgatcctgatcaaggtggagtacaagggcgaggacgccccgtgcaagatccccttcagcaccgaggacgggcagggcaaggcccacaacggccgcctgatcaccgccaaccccgtcgtgaccaagaaggaggagcccgtgaacatcgaggcggagccgcccttcggggagagcaacatcgtcatcggcatcggggacaacgccctgaagatcaactggtacaagaagggctccagcatcgggaagatgttcgaggccacggcccggggcgcccgccggatggcgatcctcggcgacaccgcctgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacgtccatgagcttctcctgcatcgccatcgggatcatcaccctgtacctgggcgcggtggtgcaggccgacatggggtgcgtcatcaactggaagggcaaggagctcaagtgcggcagcgggatcttcgtgaccaacgaggtgcacacctggacggagcagtacaagttccaggccgactcccccaagcgcctggccaccgccatcgcgggcgcctgggagaacggggtctgcggcatccgcagcaccacccggatggagaacctgctctggaagcagatcgccaacgagctgaactacatcctgtgggagaacaacatcaagctcacggtggtggtcggggacaccctgggcgtgctggagcagggcaagcgcaccctcacgccccagccgatggagctgaagtactcctggaagacgtgggggaaggccaagatcgtgaccgcggagacccagaacagctccttcatcatcgacggccccaacacccccgagtgccccagcgcctcccgggcctggaacgtctgggaggtggaggactacgggttcggcgtgttcacgaccaacatctggctgaagctccgcgaggtctacacccagctgtgcgaccaccggctgatgagcgccgccgtgaaggacgagcgcgcggtgcacgccgacatgggctactggatcgagagccagaagaacgggtcctggaagctcgagaaggccagcctgatcgaggtcaagacctgcacctggccgaagtcccacacgctgtggagcaacggcgtgctcgagtccgacatgatcatccccaagagcctggccgggcccatctcccagcacaactaccggccgggctaccacacccagaccgccgggccctggcacctgggcaagctcgagctggacttcaactactgcgagggcaccacggtggtcatcaccgagagctgcgggacccgcggcccctccctgcggaccacgaccgtgagcgggaagctcatccacgagtggtgctgccgctcctgcaccctgcccccgctgcggtacatgggcgaggacgggtgctggtacggcatggagatccgccccatcagcgagaaggaggagaacatggtgaagtccctcgtcagcgcgggctccgggaaggtggacaacttcaccatgggcgtgctgtgcctggccatcctcttcgaggaggtcctgcgggggaagttcggcaagaagcacatgatcgccggggtgttcttcacgttcgtgctgctcctgagcggccagatcacctggcgcgacatggcccacaccctgatcatgatcggctccaacgccagcgaccggatggggatgggcgtcacctacctcgcgctgatcgccacgttcaagatccagcccttcctggccctcgggttcttcctgcgcaagctgaccagccgggagaacctcctgctgggcgtgggcctcgccatggcgaccaccctgcagctgcccgaggacatcgagcagatggccaacgggatcgccctcggcctgatggccctgaagctcatcacgcagttcgagacctaccagctgtggaccgccctggtgtccctgacctgcagcaacacgatcttcaccctgaccgtcgcgtggcgcaccgccacgctgatcctcgccggggtgtccctgctgccggtctgccagagctccagcatgcggaagaccgactggctccccatgaccgtggccgccatgggcgtgccgcccctcccgctgctcatcttctccctgaaggacaccctgaagcgccgcagctggcccctcaacgagggggtcatggcggtgggcctggtgtccatcctggccagctccctcctgcggaacgacgtccccatggccggccccctggtggccgggggcctcctgatcgcctgctacgtgatcacggggaccagcgcggacctgaccgtcgagaaggccgccgacgtgacctgggaggaggaggccgagcagacgggcgtgtcccacaacctcatgatcaccgtcgacgacgacgggaccatgcgcatcaaggacgacgagaccgagaacatcctgaccgtgctgctcaagacggccctgctgatcgtgagcggcatcttcccgtactccatccccgcgaccctcctggtctggcacacctggcagaagcagacccagcggagcggcgtgctgtgggacgtgcccagcccgcccgagacgcagaaggccgagctcgaggagggggtctaccgcatcaagcagcagggcatcttcgggaagacccaggtgggcgtgggggtccagaaggagggcgtgttccacaccatgtggcacgtgacccggggcgccgtcctgacgcacaacgggaagcgcctggagcccaactgggccagcgtgaagaaggacctgatctcctacggcgggggctggcggctcagcgcgcagtggcagaagggggaggaggtgcaggtcatcgccgtggagcccggcaagaaccccaagaacttccagaccatgcccggcaccttccagaccacgaccggggagatcggcgccatcgccctggacttcaagcccgggaccagcggctcccccatcatcaaccgcgagggcaaggtggtcgggctgtacggcaacggggtggtgaccaagaacggcgggtacgtcagcggcatcgcccagacgaacgcggagccggacggccccacccccgagctcgaggaggagatgttcaagaagcggaacctgaccatcatggacctgcaccccgggtccggcaagacccgcaagtacctcccggccatcgtgcgggaggccatcaagcgccggctgcgcacgctgatcctcgcccccacccgggtggtcgccgcggagatggaggaggccctgaaggggctgcccatccgctaccagaccaccgccaccaagtccgagcacaccggccgggagatcgtggacctcatgtgccacgccaccttcaccatgcgcctgctgtcccccgtgcgggtcccgaactacaacctcatcatcatggacgaggcccacttcacggaccccgcgagcatcgccgcccgcgggtacatctccacccgggtgggcatgggcgaggccgcggccatcttcatgaccgccacgccgcccgggacggccgacgccttcccgcagagcaacgcgcccatccaggacgaggagcgcgacatccccgagcgctcctggaacagcggcaacgagtggatcaccgacttcgccgggaagaccgtgtggttcgtcccctccatcaaggccggcaacgacatcgccaactgcctgcggaagaacgggaagaaggtgatccagctgagccgcaagaccttcgacacggagtaccagaagaccaagctcaacgactgggacttcgtggtcaccaccgacatctccgagatgggcgccaacttcaaggcggaccgggtgatcgacccgcgccggtgcctgaagcccgtgatcctgacggacggccccgagcgcgtcatcctcgccgggcccatgccggtgaccgccgccagcgccgcgcagcggcgcggccgggtggggcgcaacccccagaaggagaacgaccagtacatcttcaccggccagcccctgaacaacgacgaggaccacgcccactggaccgaggccaagatgctgctcgacaacatcaacacccccgaggggatcatcccggccctgttcgagcccgagcgggagaagtccgcggccatcgacggcgagtaccgcctgaagggcgagagccggaagacgttcgtcgagctcatgcgccgcggggacctgcccgtgtggctggcccacaaggtcgcctccgagggcatcaagtacaccgaccgcaagtggtgcttcgacggggagcggaacaaccagatcctcgaggagaacatggacgtggagatctggaccaaggagggcgagcgcaagaagctgcggccccgctggctggacgcccgcacctacagcgacccgctcgcgctgaaggagttcaaggacttcgccgccggccggaagtccatcgccctggacctcgtgacggagatcgggcgcgtccccagccacctggcccaccggacccgcaacgcgctggacaacctcgtgatgctgcacaccagcgagcacggcgggcgggcctaccgccacgccgtggaggagctgcccgagaccatggagacgctcctgctgctcggcctgatgatcctgctcaccgggggcgccatgctgttcctgatctccggcaaggggatcggcaagaccagcatcgggctcatctgcgtcatcgcctccagcggcatgctgtggatggcggaggtgccgctgcagtggatcgcctccgccatcgtgctcgagttcttcatgatggtcctgctgatccccgagcccgagaagcagcggacgccccaggacaaccagctcgcctacgtggtgatcgggatcctgacgctggccgcgatcatcgccgccaacgagatgggcctcctggagaccaccaagcgcgacctgggcatgagcaaggagccgggggtcgtgtcccccaccagctacctcgacgtggacctgcaccccgcctccgcgtggacgctgtacgccgtcgccaccaccgtgatcacccccatgctccggcacacgatcgagaacagcaccgccaacgtgtccctggccgcgatcgccaaccaggccgtcgtgctgatgggcctcgacaaggggtggccgatcagcaagatggacctgggcgtgcccctgctcgccctggggtgctactcccaggtcaaccccctgaccctcaccgccgcggtgctgctgctcatcacgcactacgccatcatcggccccggcctgcaggccaaggccacccgcgaggcccagaagcggaccgcggccgggatcatgaagaacccgaccgtggacggcatcatgacgatcgacctggaccccgtcatctacgacagcaagttcgagaagcagctcggccaggtgatgctgctggtgctctgcgccgtccagctgctgctcatgcgcacctcctgggccctgtgcgaggcgctgaccctcgccaccggccccatcacgaccctgtgggagggcagccccgggaagttctggaacaccaccatcgccgtgtccatggccaacatcttccggggcagctacctggccggggcgggcctcgccttctccatcatgaagtccgtggggacgggcaagcgcggcaccgggagccagggcgagaccctgggggagaagtggaagaagaagctgaaccagctctcccggaaggagttcgacctgtacaagaagtccggcatcaccgaggtcgaccgcaccgaggccaaggaggggctgaagcggggcgagacgacccaccacgccgtgtcccgcggcagcgccaagctccagtggttcgtggagcggaacatggtcgtgccggaggggcgcgtgatcgacctgggctgcgggcggggcgggtggtcctactactgcgcgggcctgaagaaggtcaccgaggtgcgcggctacaccaagggcgggcccgggcacgaggagcccgtgcccatgagcacgtacggctggaacatcgtcaagctgatgtccgggaaggacgtgttctacctcccgcccgagaagtgcgacaccctgctgtgcgacatcggcgagagctcccccagccccaccgtggaggagtcccgcaccatccgggtcctcaagatggtggagccgtggctgaagaacaaccagttctgcatcaaggtgctgaacccctacatgcccacggtcatcgagcacctcgagcgcctgcagcggaagcacggcgggatgctggtgcgcaaccccctcagccggaactccacccacgagatgtactggatcagcaacggcaccgggaacatcgtgtccagcgtcaacatggtgtcccgcctgctgctcaaccggttcaccatgacgcaccgccggccgaccatcgagaaggacgtggacctgggcgccggcacccgccacgtcaacgccgagcccgagacccccaacatggacgtgatcggggagcggatcaagcgcatcaaggaggagcacaacagcacgtggcactacgacgacgagaacccgtacaagacctgggcctaccacggctcctacgaggtcaaggccaccgggagcgcgagctccatgatcaacggcgtggtgaagctgctcaccaagccctgggacgtcgtgcccatggtgacgcagatggccatgaccgacaccacccccttcgggcagcagcgggtcttcaaggagaaggtggacacgcgcaccccgcggcccatgcccggcacccgcaaggtgatggagatcaccgccgagtggctgtggcggacgctgggccgcaacaagcggccccgcctctgcacccgcgaggagttcaccaagaaggtccggaccaacgccgcgatgggggccgtgttcacggaggagaaccagtgggacagcgccaaggccgccgtggaggacgaggagttctggaagctggtcgaccgcgagcgggagctgcacaagctcggcaagtgcgggtcctgcgtgtacaacatgatgggcaagcgcgagaagaagctgggggagttcggcaaggcgaagggcagccgggccatctggtacatgtggctgggggcccgctacctcgagttcgaggccctgggcttcctgaacgaggaccactggttctcccgggagaacagctactccggggtggagggcgaggggctccacaagctgggctacatcctgcgcgacatcagcaagatcccgggcggggccatgtacgcggacgacaccgccggctgggacacccggatcaccgaggacgacctccacaacgaggagaagatcatccagcagatggaccccgagcaccgccagctggccaacgccatcttcaagctgacgtaccagaacaaggtcgtgaaggtgcagcggcccacccccaccgggaccgtcatggacatcatctcccgcaaggaccagcggggcagcggccaggtggggacctacggcctcaacacgttcaccaacatggaggcccagctggtgcgccagatggagggggagggcgtcctgaccaaggcggacctcgagaacccgcacctcctggagaagaagatcacccagtggctcgagacgaagggggtggagcggctgaagcgcatggccatctccggcgacgactgcgtggtcaagcccatcgacgaccggttcgccaacgccctgctcgccctgaacgacatgggcaaggtgcgcaaggacatcccccagtggcagcccagcaaggggtggcacgactggcagcaggtcccgttctgctcccaccacttccacgagctgatcatgaaggacggccggaagctcgtcgtgccctgccgcccccaggacgagctgatcgggcgggcgcgcatcagccagggcgccgggtggtccctgcgcgagaccgcctgcctcggcaaggcctacgcgcagatgtggagcctgatgtacttccaccggcgcgacctgcggctcgcctccaacgccatctgcagcgccgtgcccgtccactgggtgccgacctcccgcaccacgtggagcatccacgcccaccaccagtggatgaccaccgaggacatgctgaccgtgtggaaccgggtctggatcgaggagaacccctggatggaggacaagacgcccgtgaccacctgggagaacgtgccctacctgggcaagcgcgaggaccagtggtgcgggagcctcatcggcctgacctcccgggcgacgtgggcccagaacatcccgaccgccatccagcaggtccgcagcctgatcgggaacgaggagttcctcgactacatgccctccatgaagcggttccgcaaggaggaggagagcgagggcgccatctggtga

SEQ ID NO: 10406 - RNA, 9873 nt, synthetic construct
  misc_feature 1..9873: note = derived and/or modified CDS sequence (opt1) from DENV-3__AY744677__SS-prME
  source 1..9873: mol_type = other RNA
accagcctgtgcctcatgatgatgctgcccgccaccctggccttccacctcaccagccgcgacggcgagccccggatgatcgtggggaagaacgagcggggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacccagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtgtgggaggtcgaggactacgggttcggcgtgttcacgaccaacatctggctgaagctgcgggagatgtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtgctctgcctggccatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtgacctacctggccctcatcgccacgttcaagatccagcccttcctggccctggggttcttcctccggaagctgaccagccgcgagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcttcacgctcaccgtggcctggcggaccgccaccctgatcctggccgtcatcagcctcctgcccgtgtgccagtccagctccatgcgcaagacggactggctgccgatgaccgtggccgcgatgggggtgccgcccctccccctgttcatcttcagcctgaaggacaccctcaagcggcgctcctggccgctgaacgagggcgtgatggccgtcgggctggtgagcatcctcgcctccagcttcctgcgcaacgacgtgcccatggccggccccctggtcgccggcgggctcctgatcgcgtgctacgtgatcaccggcacgtccgccgacctgaccgtggagaaggccgccgacgtcacctgggaggaggaggccgagcagaccggggtgagccacaacctcatgatcacggtggacgacgacggcaccatgcggatcaaggacgacgagaccgagaacatcctgaccgtcctgctcaagaccgcgctgctgatcgtgtccgggatcttcccctacagcatcccggccacgctcctggtgtggcacacctggcagaagcagacccagcgctccggcgtcctgtgggacgtgccctccccgcccgagacccagaaggccgagctcgaggagggcgtgtaccggatcaagcagcaggggatcttcggcaagacgcaggtcggggtgggcgtgcagaaggagggggtcttccacaccatgtggcacgtgacccgcggcgccgtgctgacccacaacggcaagcggctggagccgaactgggcgaacgtcaagaaggacctcatctcctacgggggcgggtggaagctgagcgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgtccgggagccccatcatcaaccgcgagggcaaggtggtgggcctgtacgggaacggcgtcgtgaccaagaacgggggctacgtgagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtccgggaggccatcaagcgccggctgcgcaccctgatcctcgccccgacccgggtggtggcggccgagatggaggaggccctgaagggcctgcccatccgctaccagacgaccgccaccaagagcgagcacaccgggcgggagatcgtcgacctcatgtgccacgccacgttcaccatgcgcctgctgtcccccgtgcgggtgcccaactacaacctcatcgtcatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtgtggttcgtcccctccatcaaggccgggaacgacatcgccaactgcctgcgcaagaacggcaagaaggtgatccagctgagccgcaagaccttcgacaccgagtaccagaagaccaagctcaacgactgggacttcgtggtcacgaccgacatctccgagatgggggcgaacttcaaggccgaccgggtgatcgacccccgccggtgcctgaagccggtgatcctgaccgacggccccgagcgcgtcatcctcgccggccccatgcccgtgaccgtggccagcgccgcgcagcggcgcgggcgggtcggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtgtggctggcccacaaggtcgcctccgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctacagcgaccccctcgcgctgaaggagttcaaggacttcgccgccggccggaagtccatcgccctggacctcgtcaccgagatcggccgcgtgccgagccacctggcccaccgcacccggaacgcgctggacaacctcgtgatgctgcacacgtccgagcacgggggccgcgcctaccggcacgccgtcgaggagctgcccgagaccatggagaccctcctgctgctcgggctgatgatcctgctcaccggcggggccatgctgttcctgatcagcggcaagggcatcgggaagacgagcatcggcctcatctgcgtggtggcctccagcgggatgctgtggatggcggacgtccccctgcagtggatcgcctccgccatcgtgctcgagttcttcatgatggtgctgctgatcccggagcccgagaagcagcgcacgccccaggacaaccagctcgcctacgtcgtgatcggcatcctgaccctggccgcgatcgtggccgccaacgagatggggctcctggagaccacgaagcgggacctgggcatgagcaaggagcccggcgtcgtgtccccgaccagctacctcgacgtggacctgcaccccgcctccgcgtggaccctgtacgccgtcgccaccacggtgatcacccccatgctccgccacaccatcgagaacagcaccgccaacgtgtccctggccgcgatcgccaaccaggccgtcgtgctgatggggctcgacaagggctggcccatcagcaagatggacctgggggtgccgctgctcgccctgggctgctactcccaggtcaaccccctgacgctcaccgccgcggtgctgctgctcgtgacccactacgccatcatcgggcccggcctgcaggccaaggccacccgggaggcccagaagcgcacggcggccggcatcatgaagaaccccaccgtcgacgggatcatgaccatcgacctggacccggtgatctacgacagcaagttcgagaagcagctcggccaggtgatgctgctggtcctctgcgccgtgcagctgctgctcatgcggacctcctgggccttctgcgaggcgctgacgctggccaccgggcccatcaccaccctctgggagggcagccccggcaagttctggaacacgaccatcgccgtgtccatggccaacatcttccgcgggagctacctggccggcgcggggctggccttctccatcatgaagtccgtcggcaccgggaagcggggcaccggctcccagggggagacgctcggcgagaagtggaagaagcgcctgaaccagctgagccggaaggagttcgacctctacaagaagtccgggatcaccgaggtggaccgcaccgaggccaaggagggcctgaagcgcggggagatcacccaccacgccgtgtcccgcggcagcgccaagctgcagtggttcgtcgagcggaacatggtgatccccgagggccgcgtgatcgacctcgggtgcggccgcgggggctggtcctactactgcgcggggctgaagaaggtcaccgaggtgcgcggctacacgaagggcgggccgggccacgaggagcccgtgcccatgagcacctacgggtggaacatcgtcaagctgatgtccggcaaggacgtgttctacctcccgcccgagaagtgcgacaccctgctgtgcgacatcggggagagctcccccagccccaccgtggaggagtcccggacgatccgcgtcctgaagatggtggagccctggctcaagaacaaccagttctgcatcaaggtgctgaacccctacatgcccaccgtcatcgagcacctggagcgcctccagcggaagcacggcggcatgctggtgcgcaaccccctgagccggaactccacccacgagatgtactggatcagcaacgggaccggcaacatcgtgtccagcgtcaacatggtgtcccgcctcctgctgaaccggttcacgatgacccaccgccggcccaccatcgagaaggacgtggacctcggggccggcacccgccacgtcaacgccgagccggagacgcccaacatggacgtgatcggcgagcggatccgccggatcaaggaggagcacagctccacctggcactacgacgacgagaacccctacaagacctgggcctaccacgggagctacgaggtcaaggccaccggctccgcgagcagcatgatcaacggggtggtgaagctgctgacgaagccgtgggacgtcgtgcccatggtgacccagatggccatgaccgacaccacgcccttcggccagcagcgcgtcttcaaggagaaggtggacacccggacgccccggccgatgcccgggacccggaaggtgatggagatcacggccgagtggctctggcgcaccctgggccggaacaagcgcccccggctgtgcacccgcgaggagttcatcaagaaggtccgcaccaacgccgcgatgggcgccgtgttcacggaggagaaccagtgggactccgcccgggccgccgtggaggacgaggagttctggaagctcgtcgaccgcgagcgggagctgcacaagctggggaagtgcggcagctgcgtgtacaacatgatggggaagcgcgagaagaagctcggcgagttcgggaaggcgaagggctcccgggccatctggtacatgtggctgggcgcccgctacctggagttcgaggccctcgggttcctgaacgaggaccactggttcagccgggagaactcctacagcggcgtggagggggagggcctgcacaagctcgggtacatcctgcgcgacatctccaagatccccggcggcgccatgtacgcggacgacaccgccgggtgggacacccggatcaccgaggacgacctgcacaacgaggagaagatcacgcagcagatggacccggagcaccgccagctcgccaacgccatcttcaagctgacctaccagaacaaggtcgtgaaggtgcagcggcccacccccaagggcaccgtcatggacatcatcagccgcaaggaccagcgggggtccggccaggtgggcacgtacgggctgaacaccttcaccaacatggaggcccagctcatccgccagatggagggcgagggggtgctgagcaaggcggacctggagaacccccacctcctggagaagaaggtcacccagtggctggagaccaagggcgtggagcggctcaagcgcatggccatctccggggacgactgcgtggtcaagccgatcgacgaccggttcgccaacgccctgctggccctcaacgacatgggcaaggtgcgcaaggacatcccccagtggcagcccagcaagggctggcacgactggcagcaggtccccttctgctcccaccacttccacgagctgatcatgaaggacgggcggaagctggtcgtgccgtgccgcccccaggacgagctcatcggccgggcgcgcatcagccagggggccggctggtccctgcgcgagacggcctgcctggggaaggcctacgcgcagatgtgggccctcatgtacttccaccggcgcgacctgcggctggccagcaacgccatctgctccgccgtgcccgtccactgggtgcccaccagccgcaccacctggtccatccacgcgcaccaccagtggatgacgaccgaggacatgctcaccgtgtggaaccgggtctggatcgaggacaacccgtggatggaggacaagacccccgtgacgacctgggaggacgtgccctacctgggcaagcgcgaggaccagtggtgcggcagcctgatcgggctcaccagccgggccacctgggcccagaacatcctgacggccatccagcaggtccgctccctgatcggcaacgaggagttcctcgactacatgcccagcatgaagcggttccgcaaggaggaggagtccgagggggccatctggtga

SEQ ID NO: 10407 - RNA, 9873 nt, synthetic construct
  misc_feature 1..9873: note = derived and/or modified CDS sequence (opt1) from DENV-3__AY744678__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacccagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtgtgggaggtcgaggactacgggttcggcgtgttcacgaccaacatctggctgaagctgcgggagatgtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtgctctgcctggccatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtgacctacctggccctcatcgccacgttcaagatccagcccttcctggccctggggttcttcctccggaagctgaccagccgcgagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcttcacgctcaccgtggcctggcggaccgccaccctgatcctggccgtcatcagcctcctgcccgtgtgccagtccagctccatgcgcaagacggactggctgccgatgaccgtggccgcgatgggggtgccgcccctccccctgttcatcttcagcctgaaggacaccctcaagcggcgctcctggccgctgaacgagggcgtgatggccgtcgggctggtgagcatcctcgcctccagcttcctgcgcaacgacgtgcccatggccggccccctggtcgccggcgggctcctgatcgcgtgctacgtgatcaccggcacgtccgccgacctgaccgtggagaaggccgccgacgtcacctgggaggaggaggccgagcagaccggggtgagccacaacctcatgatcacggtggacgacgacggcaccatgcggatcaaggacgacgagaccgagaacatcctgaccgtcctgctcaagaccgcgctgctgatcgtgtccgggatcttcccctacagcatcccggccacgctcctggtgtggcacacctggcagaagcagacccagcgctccggcgtcctgtgggacgtgccctccccgcccgagacccagaaggccgagctcgaggagggcgtgtaccggatcaagcagcaggggatcttcggcaagacgcaggtcggggtgggcgtgcagaaggagggggtcttccacaccatgtggcacgtgacccgcggcgccgtgctgacccacaacggcaagcggctggagccgaactgggcgaacgtcaagaaggacctcatctcctacgggggcgggtggaagctgagcgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgtccgggagccccatcatcaaccgcgagggcaaggtggtgggcctgtacgggaacggcgtcgtgaccaagaacgggggctacgtgagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtccgggaggccatcaagcgccggctgcgcaccctgatcctcgccccgacccgggtggtggcggccgagatggaggaggccctgaagggcctgcccatccgctaccagacgaccgccaccaagagcgagcacaccgggcgggagatcgtcgacctcatgtgccacgccacgttcaccatgcgcctgctgtcccccgtgcgggtgcccaactacaacctcatcgtcatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtgtggttcgtcccctccatcaaggccgggaacgacatcgccaactgcctgcgcaagaacggcaagaaggtgatccagctgagccgcaagaccttcgacaccgagtaccagaagaccaagctcaacgactgggacttcgtggtcacgaccgacatctccgagatgggggcgaacttcaaggccgaccgggtgatcgacccccgccggtgcctgaagccggtgatcctgaccgacggccccgagcgcgtcatcctcgccggccccatgcccgtgaccgtggccagcgccgcgcagcggcgcgggcgggtcggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtgtggctggcccacaaggtcgcctccgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctacagcgaccccctcgcgctgaaggagttcaaggacttcgccgccggccggaagtccatcgccctggacctcgtcaccgagatcggccgcgtgccgagccacctggcccaccgcacccggaacgcgctggacaacctcgtgatgctgcacacgtccgagcacgggggccgcgcctaccggcacgccgtcgaggagctgcccgagaccatggagaccctcctgctgctcgggctgatgatcctgctcaccggcggggccatgctgttcctgatcagcggcaagggcatcgggaagacgagcatcggcctcatctgcgtggtggcctccagcgggatgctgtggatggcggacgtccccctgcagtggatcgcctccgccatcgtgctcgagttcttcatgatggtgctgctgatcccggagcccgagaagcagcgcacgccccaggacaaccagctcgcctacgtcgtgatcggcatcctgaccctggccgcgatcgtggccgccaacgagatggggctcctggagaccacgaagcgggacctgggcatgagcaaggagcccggcgtcgtgtccccgaccagctacctcgacgtggacctgcaccccgcctccgcgtggaccctgtacgccgtcgccaccacggtgatcacccccatgctccgccacaccatcgagaacagcaccgccaacgtgtccctggccgcgatcgccaaccaggccgtcgtgctgatggggctcgacaagggctggcccatcagcaagatggacctgggggtgccgctgctcgccctgggctgctactcccaggtcaaccccctgacgctcaccgccgcggtgctgctgctcgtgacccactacgccatcatcgggcccggcctgcaggccaaggccacccgggaggcccagaagcgcacggcggccggcatcatgaagaaccccaccgtcgacgggatcatgaccatcgacctggacccggtgatctacgacagcaagttcgagaagcagctcggccaggtgatgctgctggtcctctgcgccgtgcagctgctgctcatgcggacctcctgggccttctgcgaggcgctgacgctggccaccgggcccatcaccaccctctgggagggcagccccggcaagttctggaacacgaccatcgccgtgtccatggccaacatcttccgcgggagctacctggccggcgcggggctggccttctccatcatgaagtccgtcggcaccgggaagcggggcaccggctcccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtgtcccggggcagcgccaagctgcagtggttcgtcgagcgcaacatggtgatccccgagggccgggtgatcgacctcgggtgcggccgcgggggctggtcctactactgcgcggggctgaagaaggtcaccgaggtgcggggctacacgaagggcgggccgggccacgaggagcccgtgcccatgagcacctacgggtggaacatcgtcaagctgatgtccggcaaggacgtgttctacctcccgcccgagaagtgcgacaccctgctgtgcgacatcggggagagctcccccagccccaccgtggaggagtcccgcacgatccgggtcctgaagatggtggagccctggctcaagaacaaccagttctgcatcaaggtgctgaacccctacatgcccaccgtcatcgagcacctggagcgcctccagcgcaagcacggcggcatgctggtgcggaaccccctgagccgcaactccacccacgagatgtactggatcagcaacgggaccggcaacatcgtgtccagcgtcaacatggtgtcccggctcctgctgaaccgcttcacgatgacccaccggcgccccaccatcgagaaggacgtggacctcggggccggcacccggcacgtcaacgccgagccggagacgcccaacatggacgtgatcggcgagcgcatccggcgcatcaaggaggagcacagctccacctggcactacgacgacgagaacccctacaagacctgggcctaccacgggagctacgaggtcaaggccaccggctccgcgagcagcatgatcaacggggtggtgaagctgctgacgaagccgtgggacgtcgtgcccatggtgacccagatggccatgaccgacaccacgcccttcggccagcagcgggtcttcaaggagaaggtggacacccgcacgccccggccgatgcccgggacccgcaaggtgatggagatcacggccgagtggctctggcggaccctgggccgcaacaagcggccccgcctgtgcacccgggaggagttcatcaagaaggtccgcaccaacgccgcgatgggcgccgtgttcacggaggagaaccagtgggactccgcccgcgccgccgtggaggacgaggagttctggaagctcgtcgaccgggagcgcgagctgcacaagctggggaagtgcggcagctgcgtgtacaacatgatggggaagcgggagaagaagctcggcgagttcgggaaggcgaagggctcccgcgccatctggtacatgtggctgggcgcccggtacctggagttcgaggccctcgggttcctgaacgaggaccactggttcagccgcgagaactcctacagcggcgtggagggggagggcctgcacaagctcgggtacatcctgcgggacatctccaagatccccggcggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaagggcaccgtcatggacatcatcagccggaaggaccagcgcgggtccggccaggtgggcacgtacgggctgaacaccttcaccaacatggaggcccagctcatccggcagatggagggcgagggggtgctgagcaaggcggacctggagaacccccacctcctggagaagaaggtcacccagtggctggagaccaagggcgtggagcgcctcaagcggatggccatctccggggacgactgcgtggtcaagccgatcgacgaccgcttcgccagcgccctgctggccctcaacgacatgggcaaggtgcggaaggacatcccccagtggcagccctccaagggctggcacgactggcagcaggtccccttctgcagccaccacttccacgagctgatcatgaaggacgggcgcaagctggtcgtgccgtgccggccccaggacgagctcatcggccgcgcgcggatctcccagggggccggctggagcctgcgcgagacggcctgcctggggaaggcctacgcgcagatgtgggccctcatgtacttccaccgccgggacctgcgcctggcctccaacgccatctgcagcgccgtgcccgtccactgggtgcccacctcccggaccacctggagcatccacgcgcaccaccagtggatgacgaccgaggacatgctcaccgtgtggaaccgcgtctggatcgaggacaacccgtggatggaggacaagacccccgtgacgacctgggaggacgtgccctacctgggcaagcgggaggaccagtggtgcggcagcctgatcgggctcacctcccgcgccacctgggcccagaacatcctgacggccatccagcaggtccggagcctgatcggcaacgaggagttcctcgactacatgccctccatgaagcgcttccggaaggaggaggagagcgagggggccatctggtga

SEQ ID NO: 10408 - RNA, 9873 nt, synthetic construct
  misc_feature 1..9873: note = derived and/or modified CDS sequence (opt1) from DENV-3__AY744679__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggtcgtgcagcacgagaacctcaagtacacggtgatcatcaccgtccacaccggggaccagcaccaggtgggcaacgagacccagggggtcacggccgagatcacgccccaggcctccaccgtggaggccatcctgcccgagtacggcaccctggggctcgagtgcagcccccgcaccggcctggacttcaacgagatgatcctgctcacgatgaagaacaaggcgtggatggtgcaccggcagtggttcttcgacctgccgctgccctggacctccggcgccaccaccgagacgcccacctggaacaagaaggagctcctggtcaccttcaagaacgcccacgccaagaagcaggaggtggtggtcctggggagccaggagggcgccatgcacaccgcgctcacgggggccaccgagatccagacctccggcgggaccagcatcttcgccggccacctgaagtgccgcctgaagatggacaagctcgagctgaagggcatgtcctacgccatgtgcctgaacgccttcgtgctcaagaaggaggtgagcgagacgcagcacgggaccatcctgatcaaggtcgagtacaagggcgaggacgcgccctgcaagatcccgttcagcaccgaggacgggcagggcaaggcccacaacggccggctgatcaccgccaaccccatcgtgacgaagaaggaggagcccgtgaacatcgaggccgagcccccgttcggggagtccaacatcgtcatcggcatcggggacaaggcgctgaagatcaactggtacaagaagggcagctccatcgggaagatgttcgaggccaccgcccgcggcgcccggcgcatggccatcctcggcgacaccgcgtgggacttcgggagcgtgggcggggtgctgaactccctgggcaagatggtccaccagatcttcgggagcgcctacaccgccctcttctccggcgtgagctggatcatgaagatcggcatcggggtgctgctgacgtggatcggcctcaactccaagaacaccagcatgtccttcagctgcatcgtcatcgggatcatcaccctgtacctgggcgccgtggtgcaggccgacatggggtgcgtcatcaactggaagggccaggagctcaagtgcggctccgggatcttcgtgaccaacgaggtgcacacgtggaccgagcagtacaagttccaggcggacagccccaagcggctggccaccgccatcgccggcgcctgggagaacggggtctgcggcatccgctccaccacgcgcatggagaacctgctctggaagcagatcgcgaacgagctgaactacatcctgtgggagaacaacatcaagctcaccgtggtggtcggggacgtgatcggcgtgctggagcagggcaagcggaccctgacgccccagcccatggagctcaagtacagctggaagacgtgggggaaggccaagatcgtcaccgccgagacccagaactccagcttcatcatcgacggcccgaacacccccgagtgcccctccgccagccgcgcgtggaacgtgtgggaggtggaggactacgggttcggcgtcttcacgaccaacatctggctgaagctgcgggagatgtacacccagctctgcgaccaccgcctgatgagcgccgccgtgaaggacgagcgggccgtgcacgccgacatgggctactggatcgagtcccagaagaacgggagctggaagctggagaaggcgtccctcatcgaggtcaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtggtcatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtctccgccggcagcgggaaggccgacaacttcaccatgggcgtgctctgcctggcgatcctgttcgaggaggtgatgcgcgggaagttcggcaagaagcacatgatcgccggggccctcttcacgttcgtcctgctgctctccggccagatcacctggcgggacatggcccacaccctgatcatgatcggcagcaacgcctccgaccgcatggggatgggcgtgacctacctggcgctcatcgccacgttcaagatccagcccttcctggccctggggttcttcctccggaagctgaccagccgcgagaacctgctcctgggcgtgggcctggccatggcgaccaccctccagctgcccgaggacatcgagcagatggccaacgggatcgccctgggcctcatggccctgaagctgatcacgcagttcgagacctaccagctctggaccgccctggtcagcctgatgtgctccaacaccatcttcacgctcaccgtggcgtggcggaccgccaccctgatcctggccgtgatcagcctcctgcccgtctgccagtccagctccatgcgcaagacggactggctgccgatgaccgtggccgccatgggggtgccgcccctccccctgttcatcttcagcctgaaggacaccctcaagcggcgctcctggccgctgaacgagggcgtgatggcggtggggctggtcagcatcctcgcctccagcttcctgcgcaacgacgtgcccatggccggccccctggtggccggcgggctcctgatcgcctgctacgtcatcaccggcacgtccgcggacctgaccgtggagaaggccgccgacgtgacctgggaggaggaggccgagcagaccggggtcagccacaacctcatgatcacggtggacgacgacggcaccatgcggatcaaggacgacgagaccgagaacatcctgaccgtgctgctcaagaccgccctgctgatcgtctccgggatcttcccctacagcatcccggcgacgctcctggtgtggcacacctggcagaagcagacccagcgctccggcgtgctgtgggacgtcccctccccgcccgagacccagaaggccgagctcgaggagggcgtgtaccggatcaagcagcaggggatcttcggcaagacccaggtgggggtcggcgtgcagaaggagggggtgttccacaccatgtggcacgtcacccgcggcgccgtgctgacccacaacggcaagcggctggagccgaactgggccaacgtgaagaaggacctcatctcctacgggggcgggtggaagctgagcgcgcagtggcagaagggcgaggaggtccaggtgatcgccgtggagcccgggaagaaccccaagaacttccagacgatgcccggcatcttccagaccaccaccggcgagatcggggccatcgccctggacttcaagccgggcacgtccgggagccccatcatcaaccgcgagggcaaggtcgtgggcctgtacgggaacggcgtggtcaccaagaacgggggctacgtgagcgggatcgcccagaccaacgcggagcccgacggcccgacccccgagctcgaggaggagatgttcaagaagcggaacctgacgatcatggacctgcaccccggctccgggaagacccgcaagtacctccccgccatcgtgcgggaggccatcaagcgccggctgcgcaccctgatcctcgccccgacccgggtcgtggccgcggagatggaggaggccctgaagggcctgcccatccgctaccagacgaccgccaccaagagcgagcacaccgggcgggagatcgtggacctcatgtgccacgccacgttcaccatgcgcctgctgtcccccgtccgggtgcccaactacaacctcatcgtgatggacgaggcccacttcaccgacccggcgagcatcgccgcccgcggctacatctccacccgggtcgggatgggcgaggccgcggccatcttcatgacggccacgccgcccggcaccgccgacgccttcccccagagcaacgcgccgatccaggacgaggagcgcgacatccccgagcggtcctggaacagcgggaacgagtggatcaccgacttcgccggcaagacggtgtggttcgtgccctccatcaaggccgggaacgacatcgccaactgcctgcgcaagaacggcaagaaggtcatccagctgagccgcaagaccttcgacaccgagtaccagaagaccaagctcaacgactgggacttcgtggtgacgaccgacatctccgagatgggggccaacttcaaggcggaccgggtcatcgacccccgccggtgcctgaagccggtgatcctgaccgacggccccgagcgcgtgatcctcgccggccccatgcccgtcaccgtggccagcgccgcccagcggcgcgggcgggtgggccgcaacccgcagaaggagaacgaccagtacatcttcacggggcagcccctgaacaacgacgaggaccacgcgcactggaccgaggccaagatgctgctcgacaacatcaacacccccgagggcatcatccccgccctgttcgagccggagcgggagaagtccgccgcgatcgacggggagtaccgcctgaagggcgagagccggaagaccttcgtcgagctcatgcgccggggcgacctgcccgtgtggctggcccacaaggtcgcctccgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctacagcgaccccctcgccctgaaggagttcaaggacttcgcggccggccggaagtccatcgccctggacctcgtgaccgagatcggccgcgtcccgagccacctggcccaccgcacccggaacgccctggacaacctcgtgatgctgcacacgtccgagcacgggggccgcgcgtaccggcacgccgtggaggagctgcccgagaccatggagaccctcctgctgctcgggctgatgatcctgctcaccggcggggccatgctgttcctgatcagcggcaagggcatcgggaagacgagcatcggcctcatctgcgtcgtggcctccagcgggatgctgtggatggccgacgtgcccctgcagtggatcgcgtccgccatcgtcctcgagttcttcatgatggtgctgctgatcccggagcccgagaagcagcgcacgccccaggacaaccagctcgcctacgtggtcatcggcatcctgaccctggccgccatcgtggcggccaacgagatggggctcctggagaccacgaagcgggacctgggcatgagcaaggagcccggcgtggtctccccgaccagctacctcgacgtggacctgcaccccgcctccgcctggaccctgtacgcggtggccaccacggtcatcacccccatgctccgccacaccatcgagaacagcaccgccaacgtgtccctggccgccatcgcgaaccaggccgtggtcctgatggggctcgacaagggctggcccatcagcaagatggacctgggggtgccgctgctcgccctgggctgctactcccaggtgaaccccctgacgctcaccgccgccgtcctgctgctcgtgacccactacgcgatcatcgggcccggcctgcaggccaaggccacccgggaggcccagaagcgcacggccgcgggcatcatgaagaaccccaccgtggacgggatcatgaccatcgacctggacccggtcatctacgacagcaagttcgagaagcagctcggccaggtgatgctgctggtgctctgcgccgtccagctgctgctcatgcggacctcctgggccttctgcgaggccctgacgctggcgaccgggcccatcaccaccctctgggagggcagccccggcaagttctggaacacgaccatcgccgtgtccatggccaacatcttccgcgggagctacctggccggcgccgggctggcgttctccatcatgaagtccgtgggcaccgggaagcggggcaccggctcccagggggagacgctcggcgagaagtggaagaagaagctgaaccagctgagccgcaaggagttcgacctctacaagaagtccgggatcaccgaggtcgaccggaccgaggccaaggagggcctgaagcgcggggagatcacccaccacgccgtgtcccggggcagcgccaagctgcagtggttcgtggagcgcaacatggtcatccccgagggccgggtgatcgacctcgggtgcggccgcgggggctggtcctactactgcgccgggctgaagaaggtgaccgaggtccggggctacacgaagggcgggccgggccacgaggagcccgtgcccatgagcacctacgggtggaacatcgtgaagctgatgtccggcaaggacgtcttctacctcccgcccgagaagtgcgacaccctgctgtgcgacatcggggagagctcccccagccccaccgtggaggagtcccgcacgatccgggtgctgaagatggtcgagccctggctcaagaacaaccagttctgcatcaaggtgctgaacccctacatgcccaccgtgatcgagcacctggagcgcctccagcgcaagcacggcggcatgctggtccggaaccccctgagccgcaactccacccacgagatgtactggatcagcaacgggaccggcaacatcgtgtccagcgtgaacatggtctcccggctcctgctgaaccgcttcacgatgacccaccggcgccccaccatcgagaaggacgtggacctcggggcgggcacccggcacgtcaacgccgagccggagacgcccaacatggacatcatcggcgagcgcatccggcgcatcaaggaggagcacagctccacctggcactacgacgacgagaacccctacaagacctgggcctaccacgggagctacgaggtgaaggccaccggctccgccagcagcatgatcaacggggtggtcaagctgctgacgaagccgtgggacgtggtgcccatggtcacccagatggcgatgaccgacaccacgcccttcggccagcagcgggtgttcaaggagaaggtggacacccgcacgccccggccgatgcccgggacccgcaaggtcatggagatcacggccgagtggctctggcggaccctgggccgcaacaagcggccccgcctgtgcacccgggaggagttcatgaagaaggtgcgcaccaacgccgccatgggcgcggtgttcacggaggagaaccagtgggactccgcccgcgccgccgtcgaggacgaggagttctggaagctcgtggaccgggagcgcgagctgcacaagctggggaagtgcggcagctgcgtgtacaacatgatggggaagcgggagaagaagctcggcgagttcgggaaggccaagggctcccgcgcgatctggtacatgtggctgggcgcccggtacctggagttcgaggccctcgggttcctgaacgaggaccactggttcagccgcgagaactcctacagcggcgtcgagggggagggcctgcacaagctcgggtacatcctgcgggacatctccaagatccccggcggcgccatgtacgccgacgacaccgcggggtgggacacccgcatcaccgaggacgacctgcacaacgaggagaagatcacgcagcagatggacccggagcaccggcagctcgccaacgccatcttcaagctgacctaccagaacaaggtggtgaaggtccagcgccccacccccaagggcaccgtgatggacatcatcagccggaaggaccagcgcgggtccggccaggtgggcacgtacgggctgaacaccttcaccaacatggaggcccagctcatccggcagatggagggcgagggggtcctgagcaaggccgacctggagaacccccacctcctggagaagaaggtgacccagtggctggagaccaagggcgtggagcgcctcaagcggatggcgatctccggggacgactgcgtcgtgaagccgatcgacgaccgcttcgccaacgccctgctggccctcaacgacatgggcaaggtgcggaaggacatcccccagtggcagcccagcaagggctggcacgactggcagcaggtccccttctgctcccaccacttccacgagctgatcatgaaggacgggcgcaagctggtggtgccgtgccggccccaggacgagctcatcggccgcgcccggatcagccagggggcgggctggtccctgcgcgagacggcctgcctggggaaggcctacgcccagatgtgggcgctcatgtacttccaccgccgggacctgcgcctggccagcaacgccatctgctccgccgtccccgtgcactgggtgcccaccagccggaccacctggtccatccacgcccaccaccagtggatgacgaccgaggacatgctcaccgtctggaaccgcgtgtggatcgaggacaacccgtggatggaggacaagacccccgtgagcacgtgggaggacgtcccctacctgggcaagcgggaggaccagtggtgcggcagcctgatcgggctcacctcccgcgcgacctgggcccagaacatcctgaccgccatccagcaggtccggagcctgatcggcaacgaggagttcctcgactacatgccctccatgaagcgcttccggaaggaggaggagagcgagggggccatctggtga

SEQ ID NO: 10409 - RNA, 9873 nt, synthetic construct
  misc_feature 1..9873: note = derived and/or modified CDS sequence (opt1) from DENV-3__AY744680__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacccagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtgtgggaggtcgaggactacgggttcggcgtgttcacgaccaacatctggctgaagctgcgggagatgtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtgctctgcctggccatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtgacctacctggccctcatcgccacgttcaagatccagcccttcctggccctggggttcttcctccggaagctgaccagccgcgagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcttcacgctcaccgtggcctggcggaccgccaccctgatcctggccgtcatcagcctcctgcccgtgtgccagtccagctccatgcgcaagacggactggctgccgatgaccgtggccgcgatgggggtgccgcccctccccctgttcatcttcagcctgaaggacaccctcaagcggcgctcctggccgctgaacgagggcgtgatggccgtcgggctggtgagcatcctcgcctccagcttcctgcgcaacgacgtgcccatggccggccccctggtcgccggcgggctcctgatcgcgtgctacgtgatcaccggcacgtccgccgacctgaccgtggagaaggccgccgacgtcacctgggaggaggaggccgagcagaccggggtgagccacaacctcatgatcacggtggacgacgacggcaccatgcggatcaaggacgacgagaccgagaacatcctgaccgtcctgctcaagaccgcgctgctgatcgtgtccgggatcttcccctacagcatcccggccacgctcctggtgtggcacacctggcagaagcagacccagcgctccggcgtcctgtgggacgtgccctccccgcccgagacccagaaggccgagctcgaggagggcgtgtaccggatcaagcagcaggggatcttcggcaagacgcaggtcggggtgggcgtgcagaaggagggggtcttccacaccatgtggcacgtgacccgcggcgccgtgctgacccacaacggcaagcggctggagccgaactgggcgaacgtcaagaaggacctcatctcctacgggggcgggtggaagctgagcgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgtccgggagccccatcatcaaccgcgagggcaaggtggtgggcctgtacgggaacggcgtcgtgaccaagaacgggggctacgtgagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtccgggaggccatcaagcgccggctgcgcaccctgatcctcgccccgacccgggtggtggcggccgagatggaggaggccctgaagggcctgcccatccgctaccagacgaccgccaccaagagcgagcacaccgggcgggagatcgtcgacctcatgtgccacgccacgttcaccatgcgcctgctgtcccccgtgcgggtgcccaactacaacctcatcgtcatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtgtggttcgtcccctccatcaaggccgggaacgacatcgccaactgcctgcgcaagaacggcaagaaggtgatccagctgagccgcaagaccttcgacaccgagtaccagaagaccaagctcaacgactgggacttcgtggtcacgaccgacatctccgagatgggggcgaacttcaaggccgaccgggtgatcgacccccgccggtgcctgaagccggtgatcctgaccgacggccccgagcgcgtcatcctcgccggccccatgcccgtgaccgtggccagcgccgcgcagcggcgcgggcgggtcggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtgtggctggcccacaaggtcgcctccgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctacagcgaccccctcgcgctgaaggagttcaaggacttcgccgccggccggaagtccatcgccctggacctcgtcaccgagatcggccgcgtgccgagccacctggcccaccgcacccggaacgcgctggacaacctcgtgatgctgcacacgtccgagcacgggggccgcgcctaccggcacgccgtcgaggagctgcccgagaccatggagaccctcctgctgctcgggctgatgatcctgctcaccggcggggccatgctgttcctgatcagcggcaagggcatcgggaagacgagcatcggcctcatctgcgtggtggcctccagcgggatgctgtggatggcggacgtccccctgcagtggatcgcctccgccatcgtgctcgagttcttcatgatggtgctgctgatcccggagcccgagaagcagcgcacgccccaggacaaccagctcgcctacgtcgtgatcggcatcctgaccctggccgcgatcgtggccgccaacgagatggggctcctggagaccacgaagcgggacctgggcatgagcaaggagcccggcgtcgtgtccccgaccagctacctcgacgtggacctgcaccccgcctccgcgtggaccctgtacgccgtcgccaccacggtgatcacccccatgctccgccacaccatcgagaacagcaccgccaacgtgtccctggccgcgatcgccaaccaggccgtcgtgctgatggggctcgacaagggctggcccatcagcaagatggacctgggggtgccgctgctcgccctgggctgctactcccaggtcaaccccctgacgctcaccgccgcggtgctgctgctcgtgacccactacgccatcatcgggcccggcctgcaggccaaggccacccgggaggcccagaagcgcacggcggccggcatcatgaagaaccccaccgtcgacgggatcatgaccatcgacctggacccggtgatctacgacagcaagttcgagaagcagctcggccaggtgatgctgctggtcctctgcgccgtgcagctgctgctcatgcggacctcctgggccttctgcgaggcgctgacgctggccaccgggcccatcaccaccctctgggagggcagccccggcaagttctggaacacgaccatcgccgtgtccatggccaacatcttccgcgggagctacctggccggcgcggggctggccttctccatcatgaagtccgtcggcaccgggaagcggggcaccggctcccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtgtcccggggcagcgccaagctgcagtggttcgtcgagcgcaacatggtgatccccgagggccgggtgatcgacctcgggtgcggccgcgggggctggtcctactactgcgcggggctgaagaaggtcaccgaggtgcggggctacacgaagggcgggccgggccacgaggagcccgtgcccatgagcacctacgggtggaacatcgtcaagctgatgtccggcaaggacgtgttctacctcccgcccgagaagtgcgacaccctgctgtgcgacatcggggagagctcccccagccccaccgtggaggagtcccgcacgatccgggtcctgaagatggtggagccctggctcaagaacaaccagttctgcatcaaggtgctgaacccctacatgcccaccgtcatcgagcacctggagcgcctccagcgcaagcacggcggcatgctggtgcggaaccccctgagccgcaactccacccacgagatgtactggatcagcaacgggaccggcaacatcgtgtccagcgtcaacatggtgtcccggctcctgctgaaccgcttcacgatgacccaccggcgccccaccatcgagaaggacgtggacctcggggccggcacccggcacgtcaacgccgagccggagacgcccaacatggacgtgatcggcgagcgcatccggcgcatcaaggaggagcacagctccacctggcactacgacgacgagaacccctacaagacctgggcctaccacgggagctacgaggtcaaggccaccggctccgcgagcagcatgatcaacggggtggtgaagctgctgacgaagccgtgggacgtcgtgcccatggtgacccagatggccatgaccgacaccacgcccttcggccagcagcgggtcttcaaggagaaggtggacacccgcacgccccggccgatgcccgggacccgcaaggtgatggagatcacggccgagtggctctggcggaccctgggccgcaacaagcggccccgcctgtgcacccgggaggagttcatcaagaaggtccgcaccaacgccgcgatgggcgccgtgttcacggaggagaaccagtgggactccgcccgcgccgccgtggaggacgaggagttctggaagctcgtcgaccgggagcgcgagctgcacaagctggggaagtgcggcagctgcgtgtacaacatgatggggaagcgggagaagaagctcggcgagttcgggaaggcgaagggctcccgcgccatctggtacatgtggctgggcgcccggtacctggagttcgaggccctcgggttcctgaacgaggaccactggttcagccgcgagaactcctacagcggcgtggagggggagggcctgcacaagctcgggtacatcctgcgggacatctccaagatccccggcggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaagggcaccgtcatggacatcatcagccggaaggaccagcgcgggtccggccaggtgggcacgtacgggctgaacaccttcaccaacatggaggcccagctcatccggcagatggagggcgagggggtgctgagcaaggcggacctggagaacccccacctcctggagaagaaggtcacccagtggctggagaccaagggcgtggagcgcctcaagcggatggccatctccggggacgactgcgtggtcaagccgatcgacgaccgcttcgccaacgccctgctggccctcaacgacatgggcaaggtgcggaaggacatcccccagtggcagcccagcaagggctggcacgactggcagcaggtccccttctgctcccaccacttccacgagctgatcatgaaggacgggcgcaagctggtcgtgccgtgccggccccaggacgagctcatcggccgcgcgcggatcagccagggggccggctggtccctgcgcgagacggcctgcctggggaaggcctacgcgcagatgtgggccctcatgtacttccaccgccgggacctgcgcctggccagcaacgccatctgctccgccgtgcccgtccactgggtgcccaccagccggaccacctggtccatccacgcgcaccaccagtggatgacgaccgaggacatgctcaccgtgtggaaccgcgtctggatcgaggacaacccgtggatggaggacaagacccccgtgacgacctgggaggacgtgccctacctgggcaagcgggaggaccagtggtgcggcagcctgatcgggctcaccagccgcgccacctgggcccagaacatcctgacggccatccagcaggtccggtccctgatcggcaacgaggagttcctcgactacatgcccagcatgaagcgcttccggaaggaggaggagtccgagggggccatctggtga

SEQ ID NO: 10410 - RNA, 9873 nt, synthetic construct
  misc_feature 1..9873: note = derived and/or modified CDS sequence (opt1) from DENV-3__AY744681__SS-prME
  source 1..9873: mol_type = other RNA
acctccctgtgcctcatgatgatgctgcccgccaccctggccttccacctcacctcccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgggacaagcggtccgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggccgcatcaccaacgtgaccacggacagccggtgccccacccagggcgaggcgatcctgccggaggagcaggaccagaactacgtctgcaagcacacctacgtggaccgcgggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggctccgagacccagggggtgacggccgagatcacgccccaggccagcaccgtcgaggcgatcctgcccgagtacggcaccctggggctcgagtgcagcccccggaccggcctggacttcaacgagatgatcctgctcacgatgaagaacaaggcctggatggtgcaccgccagtggttcttcgacctgccgctgccctggaccagcggcgccaccaccgagacgcccacctggaacaagaaggagctcctggtgaccttcaagaacgcccacgccaagaagcaggaggtcgtggtgctggggtcccaggagggcgcgatgcacaccgccctcacgggggccaccgagatccagaccagcggcgggacctccatcttcgccggccacctgaagtgccggctgaagatggacaagctcgagctgaagggcatgagctacgccatgtgcctgaacgcgttcgtcctcaagaaggaggtgagcgagacgcagcacgggaccatcctgatcaaggtggagtacaagggcgaggacgccccctgcaagatcccgttctccaccgaggacgggcagggcaaggcccacaacggccgcctgatcaccgccaaccccatcgtcacgaagaaggaggagcccgtgaacatcgaggcggagcccccgttcggggagagcaacatcgtgatcggcatcggggacaaggccctgaagatcaactggtacaagaagggctccagcatcgggaagatgttcgaggccaccgcccggggcgcccgccggatggcgatcctcggcgacaccgcctgggacttcgggtccgtcggcggggtgctgaacagcctgggcaagatggtgcaccagatcttcgggtccgcctacaccgccctcttcagcggcgtctcctggatcatgaagatcggcatcggggtgctgctgacgtggatcggcctcaacagcaagaacacctccatgagcttctcctgcatcgtgatcgggatcatcaccctgtacctgggcgccgtcgtgcaggcggacatggggtgcgtgatcaactggaagggcaaggagctcaagtgcggcagcgggatcttcgtcaccaacgaggtgcacacgtggaccgagcagtacaagttccaggccgactcccccaagcgcctggccaccgccatcgccggcgcgtgggagaacggggtgtgcggcatccgcagcaccacgcggatggagaacctgctctggaagcagatcgccaacgagctgaactacatcctgtgggagaacaacatcaagctcaccatcgtcgtgggggacgtgatcggcgtcctggagcagggcaagcgcaccctgacgccccagcccatggagctcaagtactcctggaagacgtgggggaaggccaagatcgtgaccgccgagacccagaacagctccttcatcatcgacggcccgaacacccccgagtgccccagcgcgagccgggcctggaacgtgtgggaggtcgaggactacgggttcggcgtgttcacgaccaacatctggctgaagctgcgcgagatgtacacccagctctgcgaccaccggctgatgtccgccgccgtgaaggacgagcgcgccgtccacgcggacatgggctactggatcgagagccagaagaacgggtcctggaagctggagaaggccagcctcatcgaggtgaagacctgcacctggcccaagtcccacacgctgtggagcaacggcgtgctggagtccgacatgatcatccccaagtccctcgccgggcccatctcccagcacaactaccggcccggctaccacacccagaccgccgggccgtggcacctgggcaagctggagctcgacttcaactactgcgagggcaccacggtcgtgatcaccgagaactgcgggacccgcggccccagcctgcggaccacgaccgtgtccgggaagctgatccacgagtggtgctgccgcagctgcaccctgccgcccctccggtacatgggcgaggacgggtgctggtacggcatggagatccgcccgatcaacgagaaggaggagaacatggtcaagtccctggtgagcgccggctccgggaaggcggacaacttcaccatgggcgtgctctgcctggccatcctgttcgaggaggtcatgcgggggaagttcggcaagaagcacatgatcgccggggccctcttcacgttcgtgctgctgctcagcggccagatcacctggcgcgacatggcccacaccctgatcatgatcggctccaacgcgagcgaccggatggggatgggcgtgacctacctggccctcatcgccacgttcaagatccagcccttcctggccctggggttcttcctccgcaagctgaccagccgggagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgtccctgatgtgcagcaacaccatcttcacgctcaccgtggcctggcgcaccgccaccctgatcctggccgtcatctccctcctgcccgtgtgccagagctccagcatgcggaagacggactggctgccgatgaccgtggccgcgatgggggtgccgcccctccccctgttcatcttctccctgaaggacaccctcaagcgccgcagctggccgctgaacgagggcgtgatggccgtcgggctggtgtccatcctcgccagctccttcctgcggaacgacgtgcccatggccggccccctggtcgccggcgggctcctgatcgcgtgctacgtgatcaccggcacgagcgccgacctgaccgtggagaaggccgccgacgtcacctgggaggaggaggccgagcagaccggggtgtcccacaacctcatgatcacggtggacgacgacggcaccatgcgcatcaaggacgacgagaccgagaacatcctgaccgtcctgctcaagaccgcgctgctgatcgtgagcgggatcttcccctactccatcccggccacgctcctggtgtggcacacctggcagaagcagacccagcggagcggcgtcctgtgggacgtgcccagcccgcccgagacccagaaggccgagctcgaggagggcgtgtaccgcatcaagcagcaggggatcttcggcaagacgcaggtcggggtgggcgtgcagaaggagggggtcttccacaccatgtggcacgtgacccggggcgccgtgctgacccacaacggcaagcgcctggagccgaactgggcgaacgtcaagaaggacctcatcagctacgggggcgggtggaagctgtccgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgagcgggagccccatcatcaaccgggagggcaaggtggtgggcctgtacgggaacggcgtcgtgaccaagaacgggggctacgtgtccgggatcgcgcagaccaacgccgagcccgacggcccgacccccgagctcgaggaggagatgttcaagaagcgcaacctgacgatcatggacctgcaccccggcagcgggaagacccggaagtacctccccgccatcgtccgcgaggccatcaagcggcgcctgcggaccctgatcctcgccccgacccgcgtggtggcggccgagatggaggaggccctgaagggcctgcccatccggtaccagacgaccgccaccaagtccgagcacaccgggcgcgagatcgtcgacctcatgtgccacgccacgttcaccatgcggctgctgagccccgtgcgcgtgcccaactacaacctcatcgtcatggacgaggcgcacttcaccgacccggcctccatcgccgcccggggctacatcagcacccgcgtggggatgggcgaggcggccgccatcttcatgacggccacgccgcccggcaccgccgacgcgttcccccagtccaacgccccgatccaggacgaggagcgggacatccccgagcgcagctggaactccgggaacgagtggatcaccgacttcgccggcaagacggtgtggttcgtccccagcatcaaggccgggaacgacatcgccaactgcctgcgcaagaacggcaagaaggtgatccagctgtcccggaagaccttcgacaccgagtaccagaagaccaagctcaacgactgggacttcgtggtcacgaccgacatcagcgagatgggggcgaacttcaaggccgaccgcgtgatcgacccccggcgctgcctgaagccggtgatcctgaccgacggccccgagcgggtcatcctcgccggccccatgcccgtgaccgtggcctccgccgcgcagcgccgggggcgcgtcggccggaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgcgagaagtccgcggccatcgacggggagtaccggctgaagggcgagagccgcaagaccttcgtggagctcatgcggcgcggcgacctgcccgtgtggctggcccacaaggtcgccagcgaggggatcaagtacaccgaccggaagtggtgcttcgacggcgagcgcaacaaccagatcctcgaggagaacatggacgtggagatctggacgaaggagggggagaagaagaagctgcggccccgctggctggacgcccggacctactccgaccccctcgcgctgaaggagttcaaggacttcgccgccggccgcaagagcatcgccctggacctcgtcaccgagatcggccgcgtgccgtcccacctggcccaccggacccgcaacgcgctggacaacctcgtgatgctgcacacgagcgagcacgggggccgggcctaccgccacgccgtcgaggagctgcccgagaccatggagaccctcctgctgctcgggctgatgatcctgctcaccggcggggccatgctgttcctgatcagcggcaagggcatcgggaagacgtccatcggcctcatctgcgtggtggccagctccgggatgctgtggatggcggacgtccccctgcagtggatcgccagcgccatcgtgctcgagttcttcatgatggtgctgctgatcccggagcccgagaagcagcggacgccccaggacaaccagctcgcctacgtcgtgatcggcatcctgaccctggccgcgatcgtggccgccaacgagatggggctcctggagaccacgaagcgcgacctgggcatgtccaaggagcccggcgtcgtgagcccgacctcctacctcgacgtggacctgcaccccgccagcgcgtggaccctgtacgccgtcgccaccacggtgatcacccccatgctccggcacaccatcgagaactccaccgccaacgtgagcctggccgcgatcgccaaccaggccgtcgtgctgatggggctcgacaagggctggcccatctccaagatggacctgggggtgccgctgctcgccctgggctgctacagccaggtcaaccccctgacgctcaccgccgcggtgctgctgctcgtgacccactacgccatcatcgggcccggcctgcaggccaaggccacccgcgaggcccagaagcggacggcggccggcatcatgaagaaccccaccgtcgacgggatcatgaccatcgacctggacccggtgatctacgactccaagttcgagaagcagctcggccaggtgatgctgctggtcctctgcgccgtgcagctgctgctcatgcgcaccagctgggccttctgcgaggcgctgacgctggccaccgggcccatcaccaccctctgggagggctcccccggcaagttctggaacacgaccatcgccgtgagcatggccaacatcttccgggggtcctacctggccggcgcggggctggccttcagcatcatgaagtccgtcggcaccgggaagcgcggcaccggcagccagggggagacgctcggcgagaagtggaagaagaagctgaaccagctgagccggaaggagttcgacctctacaagaagtccgggatcaccgaggtggaccgcaccgaggccaaggagggcctgaagcgcggggagatcacccaccacgccgtgagccgcggctccgccaagctgcagtggttcgtcgagcggaacatggtgatccccgagggccgcgtgatcgacctcgggtgcggccgcgggggctggagctactactgcgcggggctgaagaaggtcaccgaggtgcgcggctacacgaagggcgggccgggccacgaggagcccgtgcccatgtccacctacgggtggaacatcgtcaagctgatgagcggcaaggacgtgttctacctcccgcccgagaagtgcgacaccctgctgtgcgacatcggggagtccagcccctcccccaccgtggaggagagccggacgatccgcgtcctgaagatggtggagccctggctcaagaacaaccagttctgcatcaaggtgctgaacccctacatgcccaccgtcatcgagcacctggagcgcctccagcggaagcacggcggcatgctggtgcgcaaccccctgtcccggaacagcacccacgagatgtactggatctccaacgggaccggcaacatcgtgagctccgtcaacatggtgagccgcctcctgctgaaccggttcacgatgacccaccgccggcccaccatcgagaaggacgtggacctcggggccggcacccgccacgtcaacgccgagccggagacgcccaacatggacgtgatcggcgagcggatccgccggatcaaggaggagcactccagcacctggcactacgacgacgagaacccctacaagacctgggcctaccacgggtcctacgaggtcaaggccaccggcagcgcgagctccatgatcaacggggtggtgaagctgctgacgaagccgtgggacgtcgtgcccatggtgacccagatggccatgaccgacaccacgcccttcggccagcagcgcgtcttcaaggagaaggtggacacccggacgccccgcccgatgcccgggacccggaaggtgatggagatcaccgccgagtggctctggcgcaccctgggccggaacaagcgcccccggctgtgcacccgcgaggagttcatcaagaaggtccgcaccaacgccgcgatgggcgccgtgttcacggaggagaaccagtgggacagcgcccgggccgccgtggaggacgaggagttctggaagctcgtcgaccgcgagcgggagctgcacaagctggggaagtgcggctcctgcgtgtacaacatgatggggaagcgcgagaagaagctcggcgagttcgggaaggcgaagggcagccgggccatctggtacatgtggctgggcgcccgctacctggagttcgaggccctcgggttcctgaacgaggaccactggttctcccgggagaacagctactccggcgtggagggggagggcctgcacaagctcgggtacatcctgcgcgacatcagcaagatccccggcggcgccatgtacgcggacgacaccgccgggtgggacacccggatcaccgaggacgacctgcacaacgaggagaagatcacgcagcagatggacccggagcaccgccggctcgccaacgccatcttcaagctgacctaccagaacaaggtcgtgaaggtgcagcgccccacccccaagggcaccgtcatggacatcatctcccggaaggaccagcgcgggagcggccaggtgggcacgtacgggctgaacaccttcaccaacatggaggcccagctcatccggcagatggagggcgagggggtgctgtccaaggcggacctggagaacccccacctcctggagaagaaggtcacccagtggctggagaccaagggcgtggagcgcctcaagcggatggccatcagcggggacgactgcgtggtcaagccgatcgacgaccgcttcgccaacgccctgctggccctcaacgacatgggcaaggtgcggaaggacatcccccagtggcagccctccaagggctggcacgactggcagcaggtccccttctgcagccaccacttccacgagctgatcatgaaggacgggcgcaagctggtcgtgccgtgccggccccaggacgagctcatcggccgcgcgcgcatctcccagggggccggctggagcctgcgggagacggcctgcctggggaaggcctacgcgcagatgtgggccctcatgtacttccaccgccgggacctgcgcctggcctccaacgccatctgcagcgccgtgcccgtccactgggtgcccacctcccggaccacctggagcatccacgcgcaccaccagtggatgacgaccgaggacatgctcaccgtgtggaaccgcgtctggatcgaggacaacccgtggatggaggacaagacccccgtgacgacctgggaggacgtgccctacctgggcaagcgggaggaccagtggtgcggcagcctgatcgggctcacctcccgcgccacctgggcccagaacatcctgacggccatccagcaggtccggagcctgatcggcaacgaggagttcctcgactacatgccctccatgaagcgcttccggaaggaggaggagagcgagggggccatctggtga

SEQ ID NO: 10411 - RNA, 9873 nt, synthetic construct
  misc_feature 1..9873: note = derived and/or modified CDS sequence (opt1) from DENV-3__AY744682__SS-prME
  source 1..9873: mol_type = other RNA
accagcctgtgcctcatgatgatgctgcccgccaccctggccttccacctcacctcccgggacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcgccaggtggagaaggtcgagacctgggccttccgccaccccgggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgaccatcaccgtgcacaccggggaccagcaccaggtcggcaacgagacgcagggggtgaccgccgagatcacgccccaggcctccaccgtcgaggcgatcctgcccgagtacggcaccctggggctcgagtgcagcccccgcacgggcctggacttcaacgagatgatcctgctcaccatgaagaacaaggcctggatggtgcaccggcagtggttcttcgacctgccgctgccctggacctccggcgccaccacggagacccccacctggaacaagaaggagctcctggtgaccttcaagaacgcccacgccaagaagcaggaggtcgtggtgctggggagccaggagggcgcgatgcacacggccctcaccggggccaccgagatccagacctccggcgggacgagcatcttcgccggccacctgaagtgccgcctgaagatggacaagctcgagctgaagggcatgtcctacgccatgtgcctgaacgcgttcgtcctcaagaaggaggtgagcgagacccagcacgggaccatcctgatcaaggtggagtacaagggcgaggacgccccctgcaagatcccgttcagcaccgaggacgggcagggcaaggcccacaacggccggctgatcacggccaaccccatcgtcaccaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacacggccctcttctccggcgtcagctggatcatgaagatcggcatcggggtgctgctgacctggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcacgaacgaggtgcacacctggaccgagcagtacaagttccaggccgacagccccaagcggctggccaccgccatcgccggcgcgtgggagaacggggtgtgcggcatccgctccacgacccgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacctgggggaaggccaagatcgtgaccgccgagacccagaactccagcttcatcatcgacggcccgaacacgcccgagtgcccctccgcgagccgcgcctggaacgtgtgggaggtcgaggactacgggttcggcgtgttcaccaccaacatctggctgaagctgcgggaggtgtacacccagctctgcgaccaccgcctgatgagcgccgccgtcaaggacgagcgggccgtgcacgcggacatgggctactggatcgagtcccagaagaacgggagctggaagctggagaaggcctccctcatcgaggtgaagacctgcacgtggcccaagagccacaccctgtggtccaacggcgtcctggagagcgacatgatcatcccgaagtccctcgccgggcccatcagccagcacaactaccgccccggctaccacacccagaccgccgggccgtggcacctgggcaagctggagctcgacttcaactactgcgagggcacgaccgtggtgatcaccgagaactgcgggacccggggcccctccctgcgcacgaccaccgtcagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcacgatgggcgtcctctgcctggccatcctgttcgaggaggtgatgcgcgggaagttcggcaagaagcacatgatctccggggccctcttcaccttcgtgctgctgctcagcggccagatcacctggcgggacatggcccacaccctgatcatgatcggctccaacgccagcgaccgcatggggatgggcgtcacgtacctggcgctcatcgccaccttcaagatccagcccttcctggccctggggttcttcctccggaagctgaccagccgcgagaacctgctcctgggcgtgggcctggccatggcgaccacgctccagctgcccgaggacatcgagcagatggccaacgggatcgccctgggcctcatggccctgaagctgatcacccagttcgagacctaccagctctggaccgccctggtgtccctgatgtgcagcaacacgatcttcaccctcaccgtcgcgtggcggaccgccacgctgatcctggccgtgatctccctcctgcccgtgtgccagagctccagcatgcgcaagaccgactggctgccgatgaccgtcgccgccatgggggtgccgcccctccccctgttcatcttctccctgaaggacaccctcaagcggcgcagctggccgctgaacgagggcgtcatggcggtggggctggtgtccatcctcgccagctccttcctgcgcaacgacgtccccatggccggccccctggtggccggcgggctcctgatcgcctgctacgtgatcacgggcaccagcgcggacctgaccgtcgagaaggccgccgacgtgacctgggaggaggaggccgagcagacgggggtgtcccacaacctcatgatcaccgtcgacgacgacggcaccatgcggatcaaggacgacgagaccgagaacatcctgaccgtgctgctcaagacggccctgctgatcgtgagcgggatcttcccctactccatcccggcgaccctcctggtctggcacacctggcagaagcagacccagcgcagcggcgtgctgtgggacgtgcccagcccgcccgagacgcagaaggccgagctcgaggagggcgtctaccggatcaagcagcaggggatcttcggcaagacccaggtgggggtgggcgtccagaaggagggggtgttccacaccatgtggcacgtgacccgcggcgccgtcctgacgcacaacggcaagcggctggagccgaactgggccaacgtgaagaaggacctcatcagctacgggggcgggtggaagctgtccgcgcagtggcagaagggcgaggaggtgcaggtcatcgccgtggagcccgggaagaaccccaagaacttccagaccatgcccggcatcttccagaccaccacgggcgagatcggggccatcgccctggacttcaagccgggcaccagcgggagccccatcatcaaccgcgagggcaaggtggtcggcctgtacgggaacggcgtggtgaccaagaacgggggctacgtctccgggatcgcccagaccaacgcggagcccgacggcccgacgcccgagctcgaggaggagatgttcaagaagcggaacctgaccatcatggacctgcaccccggcagcgggaagacccgcaagtacctccccgccatcgtgcgggaggccatcaagcgccggctgcgcaccctgatcctcgccccgacgcgggtggtcgccgcggagatggaggaggccctgaagggcctgcccatccgctaccagaccaccgccaccaagtccgagcacacggggcgggagatcgtggacctcatgtgccacgccaccttcaccatgcgcctgctgagccccgtgcgggtccccaactacaacctcatcgtgatggacgaggcccacttcaccgacccggcgtccatcgccgcccgcggctacatcagcacgcgggtggggatgggcgaggccgcggccatcttcatgaccgccacgccgcccggcaccgccgacgccttcccccagtccaacgcgccgatccaggacgaggagcgcgacatccccgagcggagctggaactccgggaacgagtggatcacggacttcgccggcaagaccgtctggttcgtgcccagcatcaaggccgggaacgacatcgccaactgcctgcgcaagaacggcaagaaggtgatccagctgtcccgcaagaccttcgacaccgagtaccagaagacgaagctcaacgactgggacttcgtcgtgaccaccgacatcagcgagatgggggccaacttcaaggcggaccgggtgatcgacccccgccggtgcctgaagccggtcatcctgaccgacggccccgagcgcgtgatcctcgccggccccatgcccgtgacggtcgcctccgccgcccagcggcgcgggcgggtgggccgcaacccgcagaaggagaacgaccagtacatcttcaccgggcagcccctgaacaacgacgaggaccacgcgcactggaccgaggccaagatgctgctcgacaacatcaacacccccgagggcatcatccccgccctgttcgagccggagcgggagaagtccgccgcgatcgacggggagtaccgcctgaagggcgagagccggaagaccttcgtggagctcatgcgccggggcgacctgcccgtctggctggcccacaaggtggccagcgaggggatcaagtacacggaccgcaagtggtgcttcgacggcgagcggaacaaccagatcctcgaggagaacatggacgtcgagatctggaccaaggagggggagaagaagaagctgcgcccccggtggctggacgcccgcacctactccgaccccctcgccctgaaggagttcaaggacttcgcggccggccggaagtccatcgccctggacctcgtgaccgagatcggccgcgtgccgtcccacctggcccaccgcacgcggaacgccctggacaacctcgtcatgctgcacaccagcgagcacgggggccgcgcgtaccggcacgccgtggaggagctgcccgagaccatggagaccctcctgctgctcgggctgatgatcctgctcacgggcggggccatgctgttcctgatcagcggcaagggcatcgggaagacctccatcggcctcatctgcgtggtcgccagctccgggatgctgtggatggccgacgtgcccctgcagtggatcgcgagcgccatcgtgctcgagttcttcatgatggtcctgctgatcccggagcccgagaagcagcgcacgccccaggacaaccagctcgcctacgtggtgatcggcatcctgaccctggccgccatcgtcgcggccaacgagatggggctcctggagacgaccaagcgggacctgggcatgtccaaggagcccggcgtggtgagcccgacctcctacctcgacgtcgacctgcaccccgccagcgcctggaccctgtacgcggtggccacgaccgtgatcacccccatgctccgccacaccatcgagaactccacggccaacgtcagcctggccgccatcgcgaaccaggccgtggtgctgatggggctcgacaagggctggcccatctccaagatggacctgggggtcccgctgctcgccctgggctgctacagccaggtgaaccccctgaccctcaccgccgccgtgctgctgctcgtcacccactacgcgatcatcgggcccggcctgcaggccaaggccacgcgggaggcccagaagcgcaccgccgcgggcatcatgaagaaccccaccgtggacgggatcatgaccatcgacctggacccggtgatctacgactccaagttcgagaagcagctcggccaggtcatgctgctggtgctctgcgccgtgcagctgctgctcatgcggacgagctgggccttctgcgaggccctgaccctggcgaccgggcccatcaccacgctctgggagggctcccccggcaagttctggaacaccaccatcgccgtcagcatggccaacatcttccgcgggtcctacctggccggcgccgggctggcgttcagcatcatgaagtccgtgggcaccgggaagcggggcacgggcagccagggggagaccctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtcagccggggctccgccaagctgcagtggttcgtggagcgcaacatggtgatccccgagggccgggtcatcgacctcgggtgcggccgcgggggctggagctactactgcgccgggctgaagaaggtgacggaggtgcggggctacaccaagggcgggccgggccacgaggagcccgtccccatgtccacctacgggtggaacatcgtgaagctgatgagcggcaaggacgtgttctacctcccgcccgagaagtgcgacaccctgctgtgcgacatcggggagtccagcccctcccccacggtcgaggagagccgcaccatccgggtgctgaagatggtggagccctggctcaagaacaaccagttctgcatcaaggtcctgaacccctacatgcccaccgtgatcgagcacctggagcgcctccagcgcaagcacggcggcatgctggtgcggaaccccctgtcccgcaacagcacccacgagatgtactggatctccaacgggacgggcaacatcgtcagctccgtgaacatggtgagccggctcctgctgaaccgcttcaccatgacccaccggcgccccaccatcgagaaggacgtcgacctcggggcgggcacgcggcacgtgaacgccgagccggagacccccaacatggacgtcatcggcgagcgcatccggcgcatcaaggaggagcactccagcacctggcactacgacgacgagaacccctacaagacctgggcctaccacgggtcctacgaggtgaaggccacgggcagcgccagctccatgatcaacggggtggtcaagctgctgaccaagccgtgggacgtggtgcccatggtcacccagatggcgatgaccgacacgacccccttcggccagcagcgggtgttcaaggagaaggtggacacccgcacgccccggccgatgcccgggacgcgcaaggtcatggagatcaccgccgagtggctctggcggaccctgggccgcaacaagcggccccgcctgtgcacccgggaggagttcatcaagaaggtgcgcacgaacgccgccatgggcgcggtgttcaccgaggagaaccagtgggacagcgcccgcgccgccgtcgaggacgaggagttctggaagctcgtggaccgggagcgcgagctgcacaagctggggaagtgcggctcctgcgtgtacaacatgatggggaagcgggagaagaagctcggcgagttcgggaaggccaagggcagccgcgcgatctggtacatgtggctgggcgcccggtacctggagttcgaggccctcgggttcctgaacgaggaccactggttctcccgcgagaacagctactccggcgtcgagggggagggcctgcacaagctcgggtacatcctgcgggacatcagcaagatccccggcggcgccatgtacgccgacgacaccgcggggtgggacacccgcatcacggaggacgacctgcacaacgaggagaagatcacccagcagatggacccggagcaccggcagctcgccaacgccatcttcaagctgacctaccagaacaaggtggtgaaggtccagcgccccacccccaagggcacggtgatggacatcatctcccggaaggaccagcgcgggagcggccaggtgggcacctacgggctgaacaccttcaccaacatggaggcccagctcatccggcagatggagggcgagggggtcctgtccaaggccgacctggagaacccctacctcctggagaagaaggtgacccagtggctggagacgaagggcgtggagcgcctcaagcggatggcgatcagcggggacgactgcgtcgtgaagccgatcgacgaccgcttcgccaacgccctgctggccctcaacgacatgggcaaggtgcggaaggacatcccccagtggcagccctccaagggctggcacgactggcagcaggtccccttctgcagccaccacttccacgagctgatcatgaaggacgggcgcaagctggtggtgccgtgccggccccaggacgagctcatcggccgcgcccggatctcccagggggcgggctggagcctgcgcgagaccgcctgcctggggaaggcctacgcccagatgtgggcgctcatgtacttccaccgccgggacctgcgcctggcctccaacgccatctgcagcgccgtccccgtgcactgggtgcccacctcccggaccacgtggagcatccacgcccaccaccagtggatgaccaccgaggacatgctcaccgtctggaaccgcgtgtggatcgaggacaacccgtggatggaggacaagacgcccgtgaccacctgggaggacgtcccctacctgggcaagcgggaggaccagtggtgcggcagcctgatcgggctcacctcccgcgcgacgtgggcccagaacatcctgaccgccatccagcaggtccggagcctgatcggcaacgaggagttcctcgactacatgccctccatgaagcgcttccggaaggaggaggagagcgagggggccatctggtga

SEQ ID NO: 10412 - RNA, 9873 nt, synthetic construct
  misc_feature 1..9873: note = derived and/or modified CDS sequence (opt1) from DENV-3__AY744683__SS-prME
  source 1..9873: mol_type = other RNA
accagcctgtgcctcatgatgatgctgcccgccaccctggccttccacctcaccagccgcgacggcgagccccggatgatcgtggggaagaacgagcgcggcaagagcctgctgttcaagaccgccagcgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggagcgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacccagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtgtgggaggtcgaggactacgggttcggcgtgttcacgaccaacatctggctgaagctgcgggagatgtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtgctctgcctggccatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtgacctacctggccctcatcgccacgttcaagatccagcccttcctggccctggggttcttcctccggaagctgaccagccgcgagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcttcacgctcaccgtggcctggcggaccgccaccctgatcctggccgtcatcagcctcctgcccgtgtgccagtccagctccatgcgcaagacggactggctgccgatgaccgtggccgcgatgggggtgccgcccctccccctgttcatcttcagcctgaaggacaccctcaagcggcgctcctggccgctgaacgagggcgtgatggccgtcgggctggtgagcatcctcgcctccagcttcctgcgcaacgacgtgcccatggccggccccctggtcgccggcgggctcctgatcgcgtgctacgtgatcaccggcacgtccgccgacctgaccgtggagaaggccgccgacgtcacctgggaggaggaggccgagcagaccggggtgagccacaacctcatgatcacggtggacgacgacggcaccatgcggatcaaggacgacgagaccgagaacatcctgaccgtcctgctcaagaccgcgctgctgatcgtgtccgggatcttcccctacagcatcccggccacgctcctggtgtggcacacctggcagaagcagacccagcgctccggcgtcctgtgggacgtgccctccccgcccgagacccagaaggccgagctcgaggagggcgtgtaccggatcaagcagcaggggatcttcggcaagacgcaggtcggggtgggcgtgcagaaggagggggtcttccacaccatgtggcacgtgacccgcggcgccgtgctgacccacaacggcaagcggctggagccgaactgggcgaacgtcaagaaggacctcatctcctacgggggcgggtggaagctgagcgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgtccgggagccccatcatcaaccgcgagggcaaggtggtgggcctgtacgggaacggcgtcgtgaccaagaacgggggctacgtgagcgggatcgcgcagaccaacgccgagcccgacggcccgacccccgagctcgaggaggagatgttcaagaagcggaacctgacgatcatggacctgcaccccggctccgggaagacccgcaagtacctccccgccatcgtccgggaggccatcaagcgccggctgcgcaccctgatcctcgccccgacccgggtggtggcggccgagatggaggaggccctgaagggcctgcccatccgctaccagacgaccgccaccaagagcgagcacaccgggcgggagatcgtcgacctcatgtgccacgccacgttcaccatgcgcctgctgtcccccgtgcgggtgcccaactacaacctcatcgtcatggacgaggcgcacttcaccgacccggccagcatcgccgcccgcggctacatctccacccgggtggggatgggcgaggcggccgccatcttcatgacggccacgccgcccggcaccgccgacgcgttcccccagagcaacgccccgatccaggacgaggagcgcgacatccccgagcggtcctggaacagcgggaacgagtggatcaccgacttcgccggcaagacggtgtggttcgtcccctccatcaaggccgggaacgacatcgccaactgcctgcgcaagaacggcaagaaggtgatccagctgagccgcaagaccttcgacaccgagtaccagaagaccaagctcaacgactgggacttcgtggtcacgaccgacatctccgagatgggggcgaacttcaaggccgaccgggtgatcgacccccgccggtgcctgaagccggtgatcctgaccgacggccccgagcgcgtcatcctcgccggccccatgcccgtgaccgtggccagcgccgcgcagcggcgcgggcgggtcggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtgtggctggcccacaaggtcgcctccgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctacagcgaccccctcgcgctgaaggagttcaaggacttcgccgccggccggaagtccatcgccctggacctcgtcaccgagatcggccgcgtgccgagccacctggcccaccgcacccggaacgcgctggacaacctcgtgatgctgcacacgtccgagcacgggggccgcgcctaccggcacgccgtcgaggagctgcccgagaccatggagaccctcctgctgctcgggctgatgatcctgctcaccggcggggccatgctgttcctgatcagcggcaagggcatcgggaagacgagcatcggcctcatctgcgtggtggcctccagcgggatgctgtggatggcggacgtccccctgcagtggatcgcctccgccatcgtgctcgagttcttcatgatggtgctgctgatcccggagcccgagaagcagcgcacgccccaggacaaccagctcgcctacgtcgtgatcggcatcctgaccctggccgcgatcgtggccgccaacgagatggggctcctggagaccacgaagcgggacctgggcatgagcaaggagcccggcgtcgtgtccccgaccagctacctcgacgtggacctgcaccccgcctccgcgtggaccctgtacgccgtcgccaccacggtgatcacccccatgctccgccacaccatcgagaacagcaccgccaacgtgtccctggccgcgatcgccaaccaggccgtcgtgctgatggggctcgacaagggctggcccatcagcaagatggacctgggggtgccgctgctcgccctgggctgctactcccaggtcaaccccctgacgctcaccgccgcggtgctgctgctcgtgacccactacgccatcatcgggcccggcctgcaggccaaggccacccgggaggcccagaagcgcacggcggccggcatcatgaagaaccccaccgtcgacgggatcatgaccatcgacctggacccggtgatctacgacagcaagttcgagaagcagctcggccaggtgatgctgctggtcctctgcgccgtgcagctgctgctcatgcggacctcctgggccttctgcgaggcgctgacgctggccaccgggcccatcaccaccctctgggagggcagccccggcaagttctggaacacgaccatcgccgtgtccatggccaacatcttccgcgggagctacctggccggcgcggggctggccttctccatcatgaagtccgtcggcaccgggaagcggggcaccggctcccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtgtcccggggcagcgccaagctgcagtggttcgtcgagcgcaacatggtgatccccgagggccgggtgatcgacctcgggtgcggccgcgggggctggtcctactactgcgcggggctgaagaaggtcaccgaggtgcggggctacacgaagggcgggccgggccacgaggagcccgtgcccatgagcacctacgggtggaacatcgtcaagctgatgtccggcaaggacgtgttctacctcccgcccgagaagtgcgacaccctgctgtgcgacatcggggagagctcccccagccccaccgtggaggagtcccgcacgatccgggtcctgaagatggtggagccctggctcaagaacaaccagttctgcatcaaggtgctgaacccctacatgcccaccgtcatcgagcacctggagcgcctccagcgcaagcacggcggcatgctggtgcggaaccccctgagccgcaactccacccacgagatgtactggatcagcaacgggaccggcaacatcgtgtccagcgtcaacatggtgtcccggctcctgctgaaccgcttcacgatgacccaccggcgccccaccatcgagaaggacgtggacctcggggccggcacccggcacgtcaacgccgagccggagacgcccaacatggacgtgatcggcgagcgcatccggcgcatcaaggaggagcacagctccacctggcactacgacgacgagaacccctacaagacctgggcctaccacgggagctacgaggtcaaggccaccggctccgcgagcagcatgatcaacggggtggtgaagctgctgacgaagccgtgggacgtcgtgcccatggtgacccagatggccatgaccgacaccacgcccttcggccagcagcgggtcttcaaggagaaggtggacacccgcacgccccggccgatgcccgggacccgcaaggtgatggagatcacggccgagtggctctggcggaccctgggccgcaacaagcggccccgcctgtgcacccgggaggagttcatcaagaaggtccgcaccaacgccgcgatgggcgccgtgttcacggaggagaaccagtgggactccgcccgcgccgccgtggaggacgaggagttctggaagctcgtcgaccgggagcgcgagctgcacaagctggggaagtgcggcagctgcgtgtacaacatgatggggaagcgggagaagaagctcggcgagttcgggaaggcgaagggctcccgcgccatctggtacatgtggctgggcgcccggttcctggagttcgaggccctcgggttcctgaacgaggaccactggttcagccgcgagaactcctacagcggcgtggagggggagggcctgcacaagctcgggtacatcctgcgggacatctccaagatccccggcggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaagggcaccgtcatggacatcatcagccggaaggaccagcgcgggtccggccaggtgggcacgtacgggctgaacaccttcaccaacatggaggcccagctcatccggcagatggagggcgagggggtgctgagcaaggcggacctggagaacccccacctcctggagaagaaggtcacccagtggctggagaccaagggcgtggagcgcctcaagcggatggccatctccggggacgactgcgtggtcaagccgatcgacgaccgcttcgccaacgccctgctggccctcaacgacatgggcaaggtgcggaaggacatcccccagtggcagcccagcaagggctggcacgactggcagcaggtccccttctgctcccaccacttccacgagctgatcatgaaggacgggcgcaagctggtcgtgccgtgccggccccaggacgagctcatcggccgcgcgcggatcagccagggggccggctggtccctgcgcgagacggcctgcctggggaaggcctacgcgcagatgtgggccctcatgtacttccaccgccgggacctgcgcctggccagcaacgccatctgctccgccgtgcccgtccactgggtgcccaccagccggaccacctggtccatccacgcgcaccaccagtggatgacgaccgaggacatgctcaccgtgtggaaccgcgtctggatcgaggacaacccgtggatggaggacaagacccccgtgacgacctgggaggacgtgccctacctgggcaagcgggaggaccagtggtgcggcagcctgatcgggctcaccagccgcgccacctgggcccagaacatcctgacggccatccagcaggtccggtccctgatcggcaacgaggagttcctcgactacatgcccagcatgaagcgcttccggaaggaggaggagtccgagggggccatctggtga

SEQ ID NO: 10413 - RNA, 9873 nt, synthetic construct
  misc_feature 1..9873: note = derived and/or modified CDS sequence (opt1) from DENV-3__AY744684__SS-prME
  source 1..9873: mol_type = other RNA
accagcctgtgcctcatgatgatgctgcccgccaccctggccttccacctcacctcccgcgacggcgagccccggatgatcgtggggaagaacgagcgcggcaagagcctgctgttcaagaccgcctccgggatcaacatgtgcaccctcatcgccatggacctgggcgagatgtgcgacgacaccgtgacctacaagtgccccctgatcaccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgcggagggcgcctggcggcaggtcgagaaggtcgagacctgggccttccgccaccccgggttcaccatcctcgccctgttcctggcgcactacatcggcacctccctcacccagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgcccgaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagacccagggggtgacggccgagatcacgccccaggcctccaccgtcgaggcgatcctgcccgagtacggcaccctggggctcgagtgcagcccccgcaccggcctggacttcaacgagatgatcctgctcacgatgaagaacaaggcctggatggtgcaccggcagtggttcttcgacctgccgctgccctggacctccggcgccaccaccgagacgcccacctggaacaagaaggagctcctggtgaccttcaagaacgcccacgccaagaagcaggaggtcgtggtgctggggagccaggagggcgcgatgcacaccgccctcacgggggccaccgagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacgcagcacgggaccatcctgatcaaggtggagtacaagggcgaggacgccccctgcaagatcccgttcagcaccgaggacgggcagggcaaggcccacaacggccggctgatcaccgccaaccccatcgtcacgaagaaggaggagcccgtgaacatcgaggcggagcccccgttcggggagtccaacatcgtgatcggcatcggggacaaggccctgaagatcaactggtacaagaagggcagctccatcgggaagatgttcgaggccaccgcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacgtggatcggcctcaactccaagaacaccagcatgtccttcagctgcatcgtgatcgggatcatcaccctgtacctgggcgccgtcgtgcaggcggacatggggtgcgtgatcaactggaagggcaaggagctcaagtgcggctccgggatcttcgtcaccaacgaggtgcacacgtggaccgagcagtacaagttccaggccgacagccccaagcggctggccaccgccatcgccggcgcgtgggagaacggggtgtgcggcatccgctccaccacgcgcatggagaacctgctctggaagcagatcgccaacgagctgaactacatcctgtgggagaacaacatcaagctcaccatcgtcgtgggggacgtgatcggcgtcctggagcagggcaagcggaccctgacgccccagcccatggagctcaagtacagctggaagacgtgggggaaggccaagatcgtgaccgccgagacccagaactccagcttcatcatcgacggcccgaacacccccgagtgcccctccgcgagccgcgcctggaacgtgtgggaggtcgaggactacgggttcggcgtgttcacgaccaacatctggctgaagctgcgggagatgtacacccagctctgcgaccaccgcctgatgagcgccgccgtgaaggacgagcgggccgtccacgcggacatgggctactggatcgagtcccagaagaacgggagctggaagctggagaaggcctccctcatcgaggtgaagacctgcacctggcccaagagccacacgctgtggtccaacggcgtgctggagagcgacatgatcatcccgaagtccctcgccgggcccatcagccagcacaactaccgccccggctaccacacccagaccgccgggccgtggcacctgggcaagctggagctcgacttcaactactgcgagggcaccacggtcgtgatcaccgagaactgcgggacccggggcccctccctgcgcaccacgaccgtgagcgggaagctgatccacgagtggtgctgccggtcctgcaccctgccgcccctccgctacatgggcgaggacgggtgctggtacggcatggagatccggccgatcaacgagaaggaggagaacatggtcaagagcctggtgtccgccggcagcgggaaggcggacaacttcaccatgggcgtgctctgcctggccatcctgttcgaggaggtcatgcgcgggaagttcggcaagaagcacatgatcgccggggccctcttcacgttcgtgctgctgctctccggccagatcacctggcgggacatggcccacaccctgatcatgatcggcagcaacgcgtccgaccgcatggggatgggcgtgacctacctggccctcatcgccacgttcaagatccagcccttcctggccctggggttcttcctccggaagctgaccagccgcgagaacctgctcctgggcgtcggcctggcgatggccaccaccctccagctgcccgaggacatcgagcagatggccaacgggatcgccctgggcctcatggccctgaagctgatcacgcagttcgagacctaccagctctggaccgcgctggtgagcctgatgtgctccaacaccatcagcacgctcaccgtggcctggcggaccgccaccctgatcctggccgtcatctccctcctgcccgtgtgccagagctccagcatgcgcaagacggactggctgccgatgaccgtggccgcgatgggggtgccgcccctccccctgttcatcttctccctgaaggacaccctcaagcggcgcagctggccgctgaacgagggcgtgatggccgtcgggctggtgtccatcctcgccagctccttcctgcgcaacgacgtgcccatggccggccccctggtcgccggcgggctcctgatcgcgtgctacgtgatcaccggcacgagcgccgacctgaccgtggagaaggccgccgacgtcacctgggaggaggaggccgagcagaccggggtgtcccacaacctcatgatcacggtggacgacgacggcaccatgcggatcaaggacgacgagaccgagaacatcctgaccgtcctgctcaagaccgcgctgctgatcgtgagcgggatcttcccctactccatcccggccacgctcctggtgtggcacacctggcagaagcagacccagcgcagcggcgtcctgtgggacgtgcccagcccgcccgagacccagaaggccgagctcgaggagggcgtgtaccggatcaagcagcaggggatcttcggcaagacgcaggtcggggtgggcgtgcagaaggagggggtcttccacaccatgtggcacgtgacccgcggcgccgtgctgacccacaacggcaagcggctggagccgaactgggcgaacgtcaagaaggacctcatcagctacgggggcgggtggaagctgtccgcccagtggcagaagggcgaggaggtccaggtgatcgccgtcgagcccgggaagaaccccaagaacttccagacgatgcccggcatcttccagaccaccaccggcgagatcggggccatcgccctggacttcaagccgggcacgagcgggagccccatcatcaaccgcgagggcaaggtggtgggcctgtacgggaacggcgtcgtgaccaagaacgggggctacgtgtccgggatcgcgcagaccaacgccgagcccgacggcccgacccccgagctcgaggaggagatgttcaagaagcggaacctgacgatcatggacctgcaccccggcagcgggaagacccgcaagtacctccccgccatcgtccgggaggccatcaagcgccggctgcgcaccctgatcctcgccccgacccgggtggtggcggccgagatggaggaggccctgaagggcctgcccatccgctaccagacgaccgccaccaagtccgagcacaccgggcgggagatcgtcgacctcatgtgccacgccacgttcaccatgcgcctgctgagccccgtgcgggtgcccaactacaacctcatcgtcatggacgaggcgcacttcaccgacccggcctccatcgccgcccgcggctacatcagcacccgggtggggatgggcgaggcggccgccatcttcatgacggccacgccgcccggcaccgccgacgcgttcccccagtccaacgccccgatccaggacgaggagcgcgacatccccgagcggagctggaactccgggaacgagtggatcaccgacttcgccggcaagacggtgtggttcgtccccagcatcaaggccgggaacgacatcgccaactgcctgcgcaagaacggcaagaaggtgatccagctgtcccgcaagaccttcgacaccgagtaccagaagaccaagctcaacgactgggacttcgtggtcacgaccgacatcagcgagatgggggcgaacttcaaggccgaccgggtgatcgacccccgccggtgcctgaagccggtgatcctgaccgacggccccgagcgcgtcatcctcgccggccccatgcccgtgaccgtggcctccgccgcgcagcggcgcgggcgggtcggccgcaacccgcagaaggagaacgaccagtacatcttcacggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgaagggcgagagccggaagaccttcgtggagctcatgcgccggggcgacctgcccgtgtggctggcccacaaggtcgccagcgaggggatcaagtacaccgaccgcaagtggtgcttcgacggcgagcggaacaaccagatcctcgaggagaacatggacgtggagatctggacgaaggagggggagaagaagaagctgcgcccccggtggctggacgcccgcacctactccgaccccctcgcgctgaaggagttcaaggacttcgccgccggccggaagtccatcgccctggacctcgtcaccgagatcggccgcgtgccgtcccacctggcccaccgcacccggaacgcgctggacaacctcgtgatgctgcacacgagcgagcacgggggccgcgcctaccggcacgccgtcgaggagctgcccgagaccatggagaccctcctgctgctcgggctgatgatcctgctcaccggcggggccatgctgttcctgatcagcggcaagggcatcgggaagacgtccatcggcctcatctgcgtggtggccagctccgggatgctgtggatggcggacgtccccctgcagtggatcgccagcgccatcgtgctcgagttcttcatgatggtgctgctgatcccggagcccgagaagcagcgcacgccccaggacaaccagctcgcctacgtcgtgatcggcatcctgaccctggccgcgatcgtggccgccaacgagatggggctcctggagaccacgaagcgggacctgggcatgtccaaggagcccggcgtcgtgagcccgacctcctacctcgacgtggacctgcaccccgccagcgcgtggaccctgtacgccgtcgccaccacggtgatcacccccatgctccgccacaccatcgagaactccaccgccaacgtgagcctggccgcgatcgccaaccaggccgtcgtgctgatggggctcgacaagggctggcccatctccaagatggacctgggggtgccgctgctcgccctgggctgctacagccaggtcaaccccctgacgctcaccgccgcggtgctgctgctcgtgacccactacgccatcatcgggcccggcctgcaggccaaggccacccgggaggcccagaagcgcacggcggccggcatcatgaagaaccccaccgtcgacgggatcatgaccatcgacctggacccggtgatctacgactccaagttcgagaagcagctcggccaggtgatgctgctggtcctctgcgccgtgcagctgctgctcatgcggaccagctgggccttctgcgaggcgctgacgctggccaccgggcccatcaccaccctctgggagggctcccccggcaagttctggaacacgaccatcgccgtgagcatggccaacatcttccgcgggtcctacctggccggcgcggggctggccttcagcatcatgaagtccgtcggcaccgggaagcggggcaccggcagccagggggagacgctcggcgagaagtggaagaagaagctgaaccagctgagccgcaaggagttcgacctctacaagaagtccgggatcaccgaggtggaccggaccgaggccaaggagggcctgaagcgcggggagatcacccaccacgccgtgagccggggctccgccaagctgcagtggttcgtcgagcgcaacatggtgatccccgagggccgggtgatcgacctcgggtgcggccgcgggggctggagctactactgcgcggggctgaagaaggtcaccgaggtgcggggctacacgaagggcgggccgggccacgaggagcccgtgcccatgtccacctacgggtggaacatcgtcaagctgatgagcggcaaggacgtgttctacctcccgcccgagaagtgcgacaccctgctgtgcgacatcggggagtccagcccctcccccaccgtggaggagagccgcacgatccgggtcctgaagatggtggagccctggctcaagaacaaccagttctgcatcaaggtgctgaacccctacatgcccaccgtcatcgagcacctggagcgcctccagcgcaagcacggcggcatgctggtgcggaaccccctgtcccgcaacagcacccacgagatgtactggatctccaacgggaccggcaacatcgtgagctccgtcaacatggtgagccggctcctgctgaaccgcttcacgatgacccaccggcgccccaccatcgagaaggacgtggacctcggggccggcacccggcacgtcaacgccgagccggagacgcccaacatggacgtgatcggcgagcgcatccggcgcatcaaggaggagcactccagcacctggcactacgacgacgagaacccctacaagacctgggcctaccacgggtcctacgaggtcaaggccaccggcagcgcgagctccatgatcaacggggtggtgaagctgctgacgaagccgtgggacgtcgtgcccatggtgacccagatggccatgaccgacaccacgcccttcggccagcagcgggtcttcaaggagaaggtggacacccgcacgccccggccgatgcccgggacccgcaaggtgatggagatcacggccgagtggctctggcggaccctgggccgcaacaagcggccccgcctgtgcacccgggaggagttcatcaagaaggtccgcaccaacgccgcgatgggcgccgtgttcacggaggagaaccagtgggacagcgcccgcgccgccgtggaggacgaggagttctggaagctcgtcgaccgggagcgcgagctgcacaagctggggaagtgcggctcctgcgtgtacaacatgatggggaagcgggagaagaagctcggcgagttcgggaaggcgaagggcagccgcgccatctggtacatgtggctgggcgcccggtacctggagttcgaggccctcgggttcctgaacgaggaccactggttctcccgcgagaacagctactccggcgtggagggggagggcctgcacaagctcgggtacatcctgcgggacatcagcaagatccccggcggcgccatgtacgcggacgacaccgccgggtgggacacccgcatcaccgaggacgacctgcacaacgaggagaagatcacgcagcagatggacccggagcaccggcagctcgccaacgccatcttcaagctgacctaccagaacaaggtcgtgaaggtgcagcgccccacccccaagggcaccgtcatggacatcatctcccggaaggaccagcgcgggagcggccaggtgggcacgtacgggctgaacaccttcaccaacatggaggcccagctcatccggcagatggagggcgagggggtgctgtccaaggcggacctggagaacccccacctcctggagaagaaggtcacccagtggctggagaccaagggcgtggagcgcctcaagcggatggccatcagcggggacgactgcgtggtcaagccgatcgacgaccgcttcgccaacgccctgctggccctcaacgacatgggcaaggtgcggaaggacatcccccagtggcagccctccaagggctggcacgactggcagcaggtccccttctgcagccaccacttccacgagctgatcatgaaggacgggcgcaagctggtcgtgccgtgccggccccaggacgagctcatcggccgcgcgcggatctcccagggggccggctggagcctgcgcgagacggcctgcctggggaaggcctacgcgcagatgtgggccctcatgtacttccaccgccgggacctgcgcctggcctccaacgccatctgcagcgccgtgcccgtccactgggtgcccacctcccggaccacctggagcatccacgcgcaccaccagtggatgacgaccgaggacatgctcaccgtgtggaaccgcgtctggatcgaggacaacccgtggatggaggacaagacccccgtgacgacctgggaggacgtgccctacctgggcaagcgggaggaccagtggtgcggcagcctgatcgggctcacctcccgcgccacctgggcccagaacatcctgacggccatccagcaggtccggagcctgatcggcaacgaggagttcctcgactacatgccctccatgaagcgcttccggaaggaggaggagagcgagggggccatctggtga

SEQ ID NO: 10414 - RNA, 9873 nt, synthetic construct
  misc_feature 1..9873: note = derived and/or modified CDS sequence (opt1) from DENV-3__AY744685__SS-prME
  source 1..9873: mol_type = other RNA
accagcctgtgcctcatgatgatgctgcccgccaccctggccttccacctcacgtcccgcgacggcgagccgcggatgatcgtggggaagaacgagcgcggcaagagcctgctgttcaagaccgcgtccgggatcaacatgtgcaccctcatcgccatggacctgggcgagatgtgcgacgacaccgtcacgtacaagtgccccctgatcaccgaggtggagcccgaggacatcgactgctggtgcaacctcaccagcacctgggtgacgtacgggacctgcaaccaggccggcgagcaccggcgcgacaagcggtccgtcgccctggccccccacgtgggcatggggctggacacccgcacccagacgtggatgagcgcggagggcgcctggcggcaggtggagaaggtcgagacctgggccttccgccacccggggttcaccatcctcgccctgttcctggcgcactacatcggcacctccctcacgcagaaggtggtgatcttcatcctgctgatgctcgtcacccccagcatgaccatgcggtgcgtgggggtgggcaaccgcgacttcgtcgagggcctgtccggggccacctgggtggacgtggtcctggagcacggcgggtgcgtgacgaccatggccaagaacaagcccaccctcgacatcgagctgcagaagaccgaggccacgcagctggccaccctccggaagctgtgcatcgagggcaagatcaccaacgtgaccacggacagccgctgccccacccagggcgaggcgatcctgccggaggagcaggaccagaactacgtctgcaagcacacctacgtggaccgggggtggggcaacgggtgcggcctcttcgggaagggctccctggtgacctgcgccaagttccagtgcctggagagcatcgagggcaaggccgtccagcacgagaacctcaagtacacggtgatcatcaccgtgcacaccggggaccagcaccaggtcggcaacgagatgcagggggtgaccgccgagatcacgccccaggcctccaccgtcgaggcgatcctgcccgagtacggcaccctggggctcgagtgcagcccccgcaccggcctggacttcaacgagatgatcctgctcaccatgaagaacaaggcctggatggtgcaccggcagtggttcttcgacctgccgctgccctggacgtccggcgccaccaccgagacccccacgtggaacaagaaggagctcctggtgaccttcaagaacgcccacgccaagaagcaggaggtcgtggtgctggggagccaggagggcgcgatgcacaccgccctcaccggggccacggagatccagacctccggcgggaccagcatcttcgccggccacctgaagtgccgcctgaagatggacaagctcgagctgaagggcatgtcctacgccatgtgcctgaacgcgttcgtcctcaagaaggaggtgagcgagacccagcacgggacgatcctgatcaaggtggagtacaagggcgaggacgccccctgcaagatcccgttcagcaccgaggacgggcagggcaaggcccacaacggccggctgatcaccgccaaccccatcgtcaccaagaaggaggagcccgtgaacatcgaggcggagcccccgttcggggagtccaacatcgtgatcggcatcggggacaaggccctgaagatcaactggtacaagaagggcagctccatcgggaagatgttcgaggccacggcccgcggcgcccggcgcatggcgatcctcggcgacaccgcctgggacttcgggagcgtcggcggggtgctgaactccctgggcaagatggtgcaccagatcttcgggagcgcctacaccgccctcttctccggcgtcagctggatcatgaagatcggcatcggggtgctgctgacctggatcggcctcaactccaagaacgccagcatgtccttcagctgcatcgtgatcgggatcatcacgctgtacctgggcgcggtcgtgcaggccgacatggggtgcgtgatcaactggaagggcaaggagctcaagtgcggctccgggatcttcgtcaccaacgaggtgcacacctggaccgagcagtacaagttccaggccgacagccccaagcggctggccacggccatcgcgggcgcctgggagaacggggtgtgcggcatccgctccaccacccgcatggagaacctgctctggaagcagatcgccaacgagctgaactacatcctgtgggagaacaacatcaagctcaccatcgtcgtgggggacgtgatcggcgtcctggagcagggcaagcggacgctgaccccccagcccatggagctcaagtacagctggaagacctgggggaaggccaagatcgtgaccgcggagacgcagaactccagcttcatcatcgacggcccgaacacccccgagtgcccctccgccctgcgcgcctggaacgtgtgggaggtcgaggactacgggttcggcgtgttcaccaccaacatctggctgaagctccgggagaagtacacgcagctgtgcgaccaccgcctgatgagcgccgccgtgaaggacgagcgggcggtccacgccgacatgggctactggatcgagagccagaagaacgggtcctggaagctcgagaaggccagcctgatcgaggtgaagacctgcacctggcccaagtcccacaccctgtggagcaacggcgtgctcgagtccgacatgatcatcccgaagagcctggccgggcccatctcccagcacaactaccgccccggctaccacacccagacggccgggccgtggcacctgggcaagctcgagctggacttcaactactgcgagggcaccaccgtcgtgatcaccgagaactgcgggatccggggccccagcctgcgcacgaccaccgtgtccgggaagctcatccacgagtggtgctgccggagctgcaccctgccccccctgcgctacatgggcgaggacgggtgctggtacggcatggagatccggccgatcaacgagaaggaggagaacatggtcaagtccctcgtgagcgcgggctccgggaagacggacaacttcaccatgggcgtgctgtgcctggccatcctcttcgaggaggtcatgcgcgggaagttcggcaagaagcacatgatcgccggggccctgttcaccttcgtgctgctcctgagcggccagatcacctggcgggacatggcccacacgctgatcatgatcggctccaacgcgagcgaccgcatggggatgggcgtgacctacctcgccctgatcgccaccttcaagatccagcccttcctggccctcgggttcttcctgcggaagctgacctcccgcgagaacctcctgctgggcgtcggcctcgcgatggccacgaccctgcagctgcccgaggacatcgagcagatggccaacgggatcgccctcggcctgatggccctgaagctcatcacccagttcgagacctaccagctgtggacggcgctgatcagcctcatgtgcagcaacaccatcttcaccctgaccgtggcctggcggacggccaccctgatcctcgccgtgatctccctgctgcccgtctgccagagctccagcatgcgcaagaccgactggctcccgatgaccgtggccgcgatgggggtgccccccctgcccctgttcatcttctccctcaaggacacgctgaagcggcgcagctggccgctgaacgagggcgtcatggccgtggggctcgtctccatcctggccagctccttcctgcgcaacgacgtgcccatggccggccccctcgtggccggcgggctgctgatcgcgtgctacgtcatcaccggcaccagcgccgacctcaccgtggagaaggccgccgacgtgacgtgggaggaggaggccgagcagaccggggtctcccacaacctgatgatcaccgtggacgacgacggcaccatgcggatcaaggacgacgagacggagaacatcctgaccgtgctcctgaagaccgcgctgctcatcgtcagcgggatcttcccctactccatcccggccaccctgctggtgtggcacacctggcagaagcagacgcagcgcagcggcgtgctctgggacgtcccctccccccccgagacccagaaggccgagctggaggagggcgtgtaccggatcaagcagcaggggatcttcggcaagacccaggtgggggtcggcgtgcagaaggagggggtgttccacaccatgtggcacgtcacgcgcggcgccgtgctgacccacaacggcaagcggctcgagccgaactgggcgaacgtgaagaaggacctgatcagctacgggggcgggtggaagctgtccgcccagtggcagaagggcgaggaggtccaggtgatcgccgtggagcccgggaagaaccccaagaacttccagaccatgcccggcatcttccagaccacgaccggcgagatcggggccatcgccctggacttcaagccgggcaccagcgggtcccccatcatcaaccgcgagggcaaggtcgtgggcctctacgggaacggcgtggtcaccaagaacgggggctacgtgagcgggatcgcgcagacgaacgccgagcccgacggcccgacccccgagctggaggaggagatgttcaagaagcggaacctgaccatcatggacctccaccccggcagcgggaagacccgcaagtacctgcccgccatcgtgcgggaggccatcaagcgccggctgcgcacgctcatcctggccccgacccgggtcgtggcggccgagatggaggaggccctgaagggcctccccatccgctaccagaccaccgccacgaagtccgagcacaccgggcgggagatcgtggacctgatgtgccacgccaccttcaccatgcgcctgctcagccccgtccgggtgcccaactacaacctgatcgtgatggacgaggcgcacttcacggacccggcctccatcgccgcccgcggctacatcagcacccgggtcgggatgggcgaggcggccgccatcttcatgaccgccaccccccccggcacggccgacgcgttcccccagtccaacgccccgatccaggacgaggagcgcgacatccccgagcggagctggaactccgggaacgagtggatcaccgacttcgccggcaagaccgtgtggttcgtgcccagcatcaaggccgggaacgacatcgccaactgcctgcgcaagaacggcaagaaggtcatccagctctcccgcaagaccttcgacacggagtaccagaagaccaagctgaacgactgggacttcgtggtgaccaccgacatcagcgagatgggggcgaacttcaaggccgaccgggtcatcgacccccgccggtgcctgaagccggtgatcctcacggacggccccgagcgcgtgatcctggccggccccatgcccgtcaccgtggcctccgccgcgcagcggcgcgggcgggtgggccgcaacagccagaaggagaacgaccagtacatcttcaccgggcagccgctgaacaacgacgaggaccacgcccactggaccgaggccaagatgctcctggacaacatcaacacgcccgagggcatcatccccgccctgttcgagcccgagcgggagaagtccgcggccatcgacggggagtaccgcctcaagggcgagagccggaagaccttcgtcgagctgatgcgccggggcgacctgccggtgtggctcgcccacaaggtggcctccgaggggatcaagtacaccgaccgcaagtggtgcttcgacggcgagcggaacaaccagatcctggaggagaacatggacgtcgagatctggaccaaggagggggagaagaagaagctgcgcccccggtggctcgacgcccgcacctacagcgaccccctggcgctgaaggagttcaaggacttcgccgccggccggaagtccatcgccctcgacctggtgacggagatcggccgcgtccccagccacctggcccaccgcacccggaacgcgctcgacaacctggtgatgctgcacacctccgagcacgggggccgcgcctaccggcacgccgtggaggagctcccggagaccatggagacgctgctgctcctggggctgatgatcctcctgaccggcggggccatgctgttcctcatcagcggcaagggcatcgggaagaccagcatcggcctgatctgcgtcgtggcctccagcgggatgctgtggatggcggacgtgcccctccagtggatcgcctccgccatcgtcctggagttcttcatgatggtgctgctcatccccgagccggagaagcagcgcaccccccaggacaaccagctggcctacgtggtcatcggcatcctgacgctcgccgcgatcgtggccgccaacgagatggggctgctggagaccaccaagcgggacctcggcatgagcaaggagcccggcgtggtctcccccaccagctacctggacgtggacctgcacccggcctccgcgtggacgctctacgccgtggccaccaccgtcatcacccccatgctgcgccacacgatcgagaacagcaccgccaacgtgtccctggccgcgatcgccaaccaggccgtggtcctcatggggctggacaagggctggcccatcagcaagatggacctgggggtgcccctcctggccctgggctgctactcccaggtgaacccgctcaccctgaccgccgcggtcctgctcctggtgacgcactacgccatcatcgggcccggcctgcaggccaaggccacccgggaggcccagaagcgcaccgcggccggcatcatgaagaaccccaccgtggacgggatcatgacgatcgacctcgaccccgtcatctacgacagcaagttcgagaagcagctgggccaggtgatgctgctcgtgctgtgcgccgtccagctgctcctgatgcggacctcctgggccttctgcgaggcgctgaccctcgccaccgggccgatcacgaccctgtgggagggcagccccggcaagttctggaacaccaccatcgccgtgtccatggccaacatcttccgcgggagctacctggccggcgcggggctcgccttctccatcatgaagagcgtgggcacggggaagcggggcaccggctcccagggggagaccctgggcgagaagtggaagaagaagctgaaccagctcagccgcaaggagttcgacctgtacaagaagagcgggatcaccgaggtcgaccggacggaggccaaggagggcctgaagcgcggggagatcacccaccacgccgtgtcccggggcagcgccaagctccagtggttcgtggagcgcaacatggtcatccccgagggccgggtgatcgacctggggtgcggccgcgggggctggtcctactactgcgcggggctgaagaaggtgaccgaggtccggggctacaccaagggcgggcccggccacgaggagccggtgcccatgagcacctacgggtggaacatcgtgaagctcatgtccggcaaggacgtcttctacctgccccccgagaagtgcgacacgctgctgtgcgacatcggggagagctccccgagccccaccgtggaggagtcccgcaccatccgggtgctcaagatggtcgagccctggctgaagaacaaccagttctgcatcaaggtgctgaacccctacatgccgaccgtgatcgagcacctcgagcgcctgcagcgcaagcacggcggcatgctggtccggaaccccctcagccgcaactccacgcacgagatgtactggatcagcaacgggaccggcaacatcgtgtccagcgtgaacatggtctcccggctgctgctcaaccgcttcaccatgacccaccggcgccccacgatcgagaaggacgtggacctgggggccggcacccggcacgtgaacgccgagcccgagaccccgaacatggacgtcatcggcgagcgcatccggcgcatcaaggaggagcacagctccacctggcactacgacgacgagaacccctacaagacgtgggcctaccacgggagctacgaggtgaaggccaccggctccgcgagcagcatgatcaacggggtcgtgaagctgctcaccaagccctgggacgtggtcccgatggtgacccagatggccatgacggacaccacccccttcggccagcagcgggtgttcaaggagaaggtcgacacccgcacgccccggcccatgccggggacccgcaaggtgatggagatcaccgccgagtggctgtggcggaccctgggccgcaacaagcggccccgcctctgcacgcgggaggagttcatcaagaaggtgcgcaccaacgccgcgatgggcgccgtcttcaccgaggagaaccagtgggactccgcccgcgccgccgtggaggacgaggagttctggaagctggtggaccgggagcgcgagctgcacaagctcgggaagtgcggcagctgcgtctacaacatgatggggaagcgggagaagaagctgggcgagttcgggaaggcgaagggctcccgcgccatctggtacatgtggctgggcgcccggtacctcgagttcgaggccctggggttcctgaacgaggaccactggttcagccgcgagaactcccacagcggcgtggagggggagggcctccacaagctggggtacatcctgcgggacatctccaagatccccggcggcgccatgtacgcggacgacaccgccgggtgggacacgcgcatcaccgaggacgacctccacaacgaggagaagatcacccagcagatggaccccgagcaccggcagctggccaacgccatcttcaagctgacctaccagaacaaggtggtcaaggtgcagcgcccgacgcccaagggcaccgtgatggacatcatcagccggaaggaccagcgcgggtccggccaggtcggcacctacgggctcaacaccttcacgaacatggaggcccagctgatccggcagatggagggcgagggggtgctgagcaaggcggacctcgagaacccccacctgctggagaagaaggtgacccagtggctcgagaccaagggcgtcgagcgcctgaagcggatggccatctccggggacgactgcgtggtgaagcccatcgacgaccgcttcgccaacgccctgctcgccctgaacgacatgggcaaggtccggaaggacatcccgcagtggcagcccagcaagggctggcacgactggcagcaggtgcccttctgctcccaccacttccacgagctgatcatgaaggacgggcgcaagctcgtggtcccctgccggccgcaggacgagctgatcggccgcgcgcggatcagccagggggccggctggtccctgcgcgagaccgcctgcctcgggaaggcctacgcgcagatgtgggccctgatgtacttccaccgccgggacctgcgcctcgccagcaacgccatctgctccgccgtgcccgtgcactgggtccccaccagccggacgacctggtccatccacgcgcaccaccagtggatgaccaccgaggacatgctgacggtgtggaaccgcgtgtggatcgaggacaacccctggatggaggacaagaccccggtcaccacctgggaggacgtgccctacctgggcaagcgggaggaccagtggtgcggcagcctcatcgggctgacgagccgcgccacctgggcccagaacatcctgaccgccatccagcaggtgcggtccctcatcggcaacgaggagttcctggactacatgcccagcatgaagcgcttccggaaggaggaggagtccgagggggccatctggtga

SEQ ID NO: 10415 - RNA, 9873 nt, synthetic construct
  misc_feature 1..9873: note = derived and/or modified CDS sequence (opt1) from DENV-3__AY876494__SS-prME
  source 1..9873: mol_type = other RNA
accagcctctgcctcatgatgatgctgcccgcgaccctggccttccacctcaccagccgcgacggggagccccggatgatcgtggcgaagaacgagcgcgggaagtccctgctgttcaagaccgccagcggcatcaacatgtgcaccctcatcgccatggacctgggggagatgtgcgacgacaccgtgacctacaagtgccccctgatcgccgaggtggagcccgaggacatcgactgctggtgcaacctcaccagcacctgggtgacctacgggacctgcaaccaggccggggagcaccggcgcgacaagcggtccgtcgcgctggcgccccacgtgggcatgggcctggacacccgcacccagacctggatgagcgccgagggggcctggcggcccgtggagaaggtggagacgtgggcgctccgccaccccggcttcaccatcctggccctgttcctcgcccactacatcgggacctccctgacccagaaggtggtgatcttcatcctgctcatgctggtcacgcccagcatgaccatgcggtgcgtgggcgtggggaaccgcgacttcgtcgagggcctgtccggcgccacctgggtggacgtggtcctcgagcacgggggctgcgtgaccacgatggccaagaacaagcccaccctggacatcgagctgcagaagaccgaggcgacccagctcgccacgctgcggaagctgtgcatcgaggggaagatcaccaacgtgaccaccgacagccgctgcccgacgcagggcgaggccatcctccccgaggagcaggaccagaactacgtctgcaagcacacctacgtggaccggggctgggggaacggctgcgggctgttcggcaaggggtccctggtgacctgcgccaagttccagtgcctcgagcccatcgagggcaaggtcgtgcagcacgagaacctgaagtacaccgtgatcatcacggtccacaccggcgaccagcaccaggtggggaacgacacccagggcgtcaccgtggagatcacgccccaggccagcaccgcggaggccatcctgccggagtacgggaccctcgtgctggagtgcagcccccgcaccggcctggacttcaacgagatgatcctcctgaccatgaagaacaaggcctggatggtccaccggcagtggttcttcgacctgcccctcccctggacgagcggggccaccaccgagaccccgacgtggaaccgcaaggagctgctggtgaccttcaagaacgcccacgcgaagaagcaggaggtggtcgtgctcggctcccaggagggcgccatgcacaccgccctgaccggggccacggagatccagaacagcggcgggacctccatcttcgccggccacctgaagtgccggctcaagatggacaagctggagctgaaggggatgagctacgcgatgtgcctcaacaccttcgtgctgaagaaggaggtctccgagacccagcacggcacgatcctgatcaaggtggagtacaagggcgaggacgccccctgcaagatccccttcagcaccgaggacgggcagggcaaggcccacaacgggcgcctgatcaccgccaaccccgtggtcaccaagaaggaggagccggtgaacatcgaggcggagccgcccttcggcgagagcaacatcgtgatcggcatcggggacaaggccctcaagatcaactggtacaagaagggctccagcatcgggaagatgttcgaggccacggcccggggcgcccgccggatggcgatcctgggggacaccgcctgggacttcggctccgtcggcggggtgctgaacagcctcggcaagatggtgcaccagatcttcgggtccgcctacaccgccctgttcagcggcgtctcctggatcatgaagatcgggatcggcgtgctgctcacctggatcggcctgaacagcaagaacacgtccatgagcttctcctgcatcgtgatcgggatcatcaccctgtacctcggcgccgtcgtgcaggcggacatggggtgcgtgatcaactggaagggcaaggagctgaagtgcgggagcggcatcttcgtcaccaacgaggtgcacacctggacggagcagtacaagttccaggccgactcccccaagcgcctggccaccgccatcgccggcgcgtgggagaacggggtgtgcggcatccgcagcaccacccggatggagaacctcctgtggaagcagatcgccaacgagctgaactacatcctctgggagaacaacatcaagctgacggtcgtggtgggggacatcatcggcgtcctggagcaggggaagcgcaccctcaccccgcagcccatggagctgaagtactcctggaagacctggggcaaggccaagatcgtgacggccgagacccagaacagctccttcatcatcgacggccccaacacccccgagtgcccgagcgcgtcccgggcctggaacgtgtgggaggtcgaggactacgggttcggcgtgttcaccacgaacatctggctgaagctccgcgaggtgtacacccagagctgcgaccaccggctgatgagcgccgccatcaaggacgagcgcgccgtccacgcggacatggggtactggatcgagtcccagaagaacggcagctggaagctggagaaggcctccttcatcgaggtgaagacctgcacctggcccaagagccacaccctctggtccaacggcgtgctggagagcgacatgatcatccccaagtccctggccgggccgatcagccagcacaaccaccggcccggctactacacgcagaccgccgggccctggcacctcggcaagctggagctggacttcaactactgcgaggggaccaccgtcgtgatcacggagaactgcggcacccgcggcccctccctccggaccaccacggtgagcgggaagctgatccacgagtggtgctgccgctcctgcaccctgccgcccctccggtacatgggcgaggacgggtgctggtacggcatggagatccgccccatcaacgagaaggaggagaacatggtcaagagcctggtgtccgccgggagcggcaaggtggacaacttcaccatgggcgtcctgtgcctcgcgatcctgttcgaggaggtgatgcgggggaagttcggcaagaagcacatgatcgccggggtgctgttcaccttcgtcctcctgctgtccggccagatcacgtggcgcgacatggcccacaccctcatcatgatcgggagcaacgcctccgaccggaccggcatgggcgtgacctacctggccctgatcgcgacgttcaagatccagcccttcctcgccctggggttcttcctgcgcaagctcaccagccgggagaacctgctgctcggcgtggggctggccatggccaccaccctgcagctcccggaggacatcgagcagatggcgaacggcatcgccctgggcctgatgacgctcaagctgatcacccagttcgagacctaccagctgtggaccgccctcgtcagcctgacgtgctccaacaccatcttcaccctgaccgtggcctggcgcacggccaccctcatcctggcgggggtcagcctgctccccctgtgccagtccagctccatgcggaagaccgactggctgcccatgaccgtggccgccatgggcgtgcccccgctccccctgttcatcttcagcctgaaggacacgcccaagcgccgctcctggcccctcaacgagggggtcatggccgtgggcctggtgagcatcctggcctccagcctcctgcggaacgacgtcccgatggcggggcccctggtggccggcggcctcctgatcgcctgctacgtgatcaccgggacctccgccgacctgaccgtcgagaaggccgcggacgtgacgtgggaggaggaggccgagcagaccggcgtgagccacaacctcatgatcaccgtcgacgacgacgggaccatgcgcatcaaggacgacgagaccgagaacatccccacggtgctgctgaagaccgccctcctgatcgtgtccggcatcttcccctacagcatcccggccaccctgctcgtctggcacacctggcagaagcagacgcagcggtccggggtgctgtgggacgtgccctccccgcccgagacccagaaggccgagctggaggagggcgtctaccgcatcaagcagcagggcatcttcgggaagacccaggtgggcgtgggggtccagaaggagggcgtgttccacaccatgtggcacgtgacgcggggcgccgtcctcacccacaacggcaagcgcctggagccgaactgggcctccgtgaagaaggacctgatcagctacggcgggggctggcggctctccgcccagtggcagaagggggaggaggtgcaggtcatcgccgtggagcccggcaagaaccccaagaacttccagaccatgccggggatcttccagaccacgaccggcgagatcggcgcgatcgccctggacttcaagcccgggaccagcggcagccccatcatcaaccgcgaggggaaggtggtcggcctgtacggcaacggggtggtgaccaagaacggcgggtacgtctccggcatcgcccagacgaacgccgagcccgacgggccgacccccgagctggaggaggagatgttcaagaagcggaacctcaccatcatggacctgcaccccggcagcggcaagacccgcaagtacctgcccgccatcgtgcgggaggcgatcaagcgccggctccgcacgctgatcctggccccgacccgggtggtcgccgccgagatggaggaggccctcaaggggctgcccatccgctaccagaccaccgcgacgaagtccgagcacaccggccgggagatcgtggacctgatgtgccacgccaccttcaccatgcgcctcctgagccccgtgcgggtccccaactacaacctgatcatcatggacgaggcccacttcacggacccggcctccatcgccgcgcgcgggtacatcagcacccgggtgggcatgggggaggccgccgccatcttcatgaccgcgacgccgcccggcacggccgaggccttcccccagtccaacgccccgatccaggacgaggagcgcgacatccccgagcgcagctggaactccggcaacgagtggatcaccgacttcgtggggaagaccgtctggttcgtgcccagcatcaaggccggcaacgacatcgcgaactgcctccggaagaacgggaagaaggtgatccagctgtcccgcaagaccttcgacacggagtaccagaagacccggctgaacgactgggacttcgtcgtgaccaccgacatcagcgagatgggcgccaacttcaaggccgaccgcgtgatcgacccccggcgctgcctcaagccggtcatcctgacggacgggcccgagcgggtgatcctggccggccccatgcccgtgaccgccgcgtccgccgcccagcgccggggccgcgtcgggcggaacccgcagaaggagaacgaccagtacatcttcaccggccagcccctcaacaacgacgaggaccacgcccactggaccgaggccaagatgctgctggacaacatcaacacccccgaggggatcatccccgccctcttcgagccggagcgcgagaagtccgccgccatcgacggcgagtaccggctgaagggggagtcccgcaagacgttcgtggagctgatgcggcgcggcgacctccccgtctggctggcccacaaggtggcgagcgagggcatcaagtacaccgaccggaagtggtgcttcgacggggagcgcaacaaccagatcctggaggagaacatggacgtggagatctggaccaaggagggcgagcggaagaagctccgcccccgctggctggacgcccggacctactccgacccgctggccctcaaggagttcaaggacttcgccgccgggcgcaagagcatcgcgctggacctggtcacggagatcggccgggtgccctcccacctcgcccaccgcacccggaacgccctggacaacctggtgatgctccacaccagcgagcacggcgggcgcgcctaccggcacgccgtcgaggagctgcccgagaccatggagacgctgctcctgctgggcctcatgatcctgctgaccgggggcgcgatgctgttcctgatcagcgggaagggcatcggcaagacctccatcgggctgatctgcgtgatcgtgagctccggcatgctctggatggccgacgtccccctgcagtggatcgccagcgccatcgtgctggagttcttcatgatggtgctcctgatcccggagcccgagaagcagcgcacgccccaggacaaccagctggcctacgtcgtgatcgggatcctcacgctggcggccatcgtggccgccaacgagatgggcctgctcgagaccaccaagcgggacctggggatgtccaaggagcccggcgtcgtgagcccgacctcctacctggacgtggacctccaccccgccagcgcgtggacgctgtacgccgtcgccaccaccgtgatcacccccatgctgcgccacacgatcgagaactccaccgccaacgtgagcctcgcggccatcgccaaccaggccgtcgtgctgatgggcctggacaaggggtggcccatctccaagatggacctcggcgtgccgctgctggccctcgggtgctacagccaggtcaaccccctgaccctgaccgcggccgtgctcctgctggtgacgcactacgccatcatcggccccgggctccaggccaaggccacccgggaggcgcagaagcgcaccgccgccggcatcatgaagaaccccaccgtcgacggcatcatgacgatcgacctggacccggtgatctacgactccaagttcgagaagcagctgggccaggtgatgctcctggtcctgtgcgccgtgcagctcctgctgatgcggaccagctgggccctctgcgaggcgctgaccctggccaccggccccatcacgaccctctgggaggggtcccccggcaagttctggaacaccaccatcgccgtgagcatggccaacatcttccgcggctcctacctggcgggggccggcctggccttcagcatcatgaagtccgtcgggacgggcaagcgggggaccggcagccagggcgagaccctcggggagaagtggaagaagaagctgaaccagctgagccgcaaggagttcgacctctacaagaagtccggcatcaccgaggtggaccggaccgaggccaaggaggggctgaagcgcggcgagacgacccaccacgccgtgagccgggggtccgcgaagctgcagtggttcgtcgagcgcaacatggtgatccccgagggccgggtgatcgacctcggctgcgggcgcggcgggtggagctactactgcgccggcctgaagaaggtcaccgaggtgcgcgggtacaccaagggcggcccggggcacgaggagcccgtgcccatgtccacgtacggctggaacatcgtcaagctgatgagcgggaaggacgtgttctacctcccgcccgagaagtgcgacaccctgctgtgcgacatcggcgagtccagcccctcccccaccgtggaggagagccggaccatccgcgtcctgaagatggtggagccctggctcaagaacaaccagttctgcatcaaggtgctgaacccctacatgcccacggtcatcgagcacctggagcggctccagcgcaagtacgggggcatgctggtgcggaaccccctgtcccgcaacagcacccacgagatgtactggatctccaacggcaccgggaacatcgtgagctccgtcaacatggtgagccggctcctgctgaaccgcttcaccatgacgcaccggcgcccgaccatcgagaaggacgtcgacctcggcgccgggacccggcacgtgaacgccgagcccgagacccccaacatggacgtgatcggcgagcgcatcaagcggatcaaggaggagcactccagcacgtggcactacgacgacgagaacccctacaagacctgggcctaccacggctcctacgaggtcaaggcgaccgggagcgccagctccatgatcaacggcgtggtgaagctgctgaccaagccgtgggacgtcgtgcccatggtgacgcagatggccatgaccgacaccacccccttcgggcagcagcgcgtcttcaaggagaaggtggacacgcggacgccccgcccgatgcccggcacccggaaggtgatggagatcaccgccgagtggctctggcgcacgctggggcggaacaagcgcccccgcctgtgcacccgggaggagttcaccaagaaggtccgcaccaacgccgcgatgggcgccgtgttcacggaggagaaccagtgggacagcgcccgggccgcggtggaggacgaggagttctggaacctctgggaccgcgagcgggagctgcacaagctgggcaagtgcgggtcctgcgtctacaacatgatgggcaagcgcgagaagaagctcggggagttcggcaaggccaaggggagccgggccatctggtacatgtggctgggcgcccgctacctggagttcgaggccctcggcttcctgaacgaggaccactggttctcccgggagaacagctactccggggtggagggcgaggggctgcacaagctcggctacatcctgcgcgacatcagcaagatccccgggggcgcgatgtacgccgacgacaccgccggctgggacacccggatcaccgaggacgacctgcacaacgaggagaagatcacgcagcagatggacccggagcaccgccagctcgccaacgccatcttcaagctgacctaccagaacaaggtggtcaaggtgcagcggcccacccccaaggggaccgtgatggacatcatctcccgcaaggaccagcggggcagcgggcaggtcggcacctacggcctgaacacgttcaccaacatggaggcgcagctcgtgcgccagatggagggggagggcgtgctgtccaaggccgacctggagaacccccacctcctggagaagaagatcaccccgtggctggagcccaagggggtcgagcggctcaagcgcatggccatcagcggcgacgactgcgtggtgaagcccatcgacgaccggttcgccaacgccctgctggcgctcaacgacatggggaaggtccgcaaggacatcccccagtggcagccgtccaagggctggcacgactggcagcaggtccccttctgcagccaccacttccacgagctgatcatgaaggacggccggaagctggtggtcccctgccgcccccaggacgagctcatcgggcgcgcccggatctcccagggcgccgggtggagcctgaaggagaccgcctgcctgggcaaggcctacgcgcagatgtggtccctcatgtacttccaccgccgggacctgcgcctggccagcaacgccatctgctccgccgtgccggtgcactgggtccccacgagccggaccacctggagcatccacgcgcaccaccagtggatgaccacggaggacatgctcaccgtgtggaaccgcgtgtggatcgaggacaacccctggatggaggacaagaccccggtcaccacgtgggaggacgtgccctacctggggaagcgggaggaccagtggtgcggctccctgatcggcctcaccagccgctccacctgggcccagaacatcctgaccgccatccagcaggtccggagcctgatcggggacgaggagttcctcgactacatgccctccatgaagcgcttccggaaggaggaggagagcgagggcgccatctggtga

SEQ ID NO: 10416 - RNA, 9873 nt, synthetic construct
  misc_feature 1..9873: note = derived and/or modified CDS sequence (opt1) from DENV-3__AY923865__SS-prME
  source 1..9873: mol_type = other RNA
accagcctctgcctcatgatgatgctgcccgccaccctggccttccacctcaccagccgggacggcgagccgcggatgatcgtggggaagaacgagcggggcaagagcctgctgttcaagaccgcgtccgggatcaacatgtgcaccctcatcgccatggacctgggcgagatgtgcgacgacaccgtgacctacaagtgccccctgatcgccgaggtggagcccgaggacatcgactgctggtgcaacctcaccagcacctgggtgacctacgggacctgcaaccaggccggcgagcaccggcgcgacaagcggtccgtggccctggcgccccacgtgggcatggggctggacacccgcacccagacctggatgagcgccgagggcgcctggcgccaggtggagaaggtggagacgtgggccctccgccacccggggttcaccatcctggcgctgttcctcgcccactacatcggcacctccctgacccagaaggtggtgatcttcatcctgctcatgctggtcacgcccagcatgaccatgcggtgcgtgggggtgggcaaccgcgacttcgtcgagggcctgtccggggccacctgggtggacgtggtcctcgagcacggcgggtgcgtgaccacgatggccaagaacaagcccaccctggacatcgagctgcagaagaccgaggccacccagctcgcgacgctgcggaagctgtgcatcgagggcaagatcaccaacatcaccaccggcagccgctgccccacgcagggggaggccatcctcccggaggagcaggaccagaactacgtgtgcaagcacacctacgtcgaccggggctgggggaacggctgcgggctgttcggcaagggctccctggtgacctgcgccaagttccagtgcctcgagcccatcgaggggaaggtggtccagtacgagaacctgaagtacaccgtgatcatcacggtgcacaccggcgaccagccccaggtcgggaacgacacccagggcgtgaccgtcgagatcacgccccaggccagcaccgtggaggccgtgctgctcgagtacgggaccctgggcctgaagtgctccccgcgcaccggcctcgacttcaacgagatgatcctgctgaccatgaagacgaaggcgtggatggtccaccggcagtggttcttcgacctccccctgccctggaccagcggggccaccaccgagacgcccacctggaaccgcaaggagctgctcgtgaccttcaagaacgcccacgccaagaagcaggaggtggtcgtgctgggctcccaggagggggccatgcacaccgcgctgacgggcgccaccgagatccagaacagcgggggcacctccatcttcgccggccacctcaagtgccggctgaagatggacaagctggagctcaaggggatgagctacgccatgtgcctgaacaccttcgtgctgaagaaggaggtctccgagacgcagcacggcaccatcctgatcaaggtggagtacaagggggaggacgccccgtgcaagatccccttcagcaccgaggacggccagggcaaggcgcacaacgggcgcctcatcaccgccaaccccgtggtcacgaagaaggaggagcccgtgaacatcgaggccgagccgcccttcggcgagagcaacatcgtgatcgggatcggcgacaaggccctgaagatcaactggtacaagaaggggtccagcatcggcaagatgttcgaggcgaccgcccggggcgcccgccggatggccatcctgggggacaccgcctgggacttcggctccgtcgggggcgtgctcaacagcctggggaagatggtgcaccagatcttcggctccgcgtacaccgccctgttcagcggcgtctcctggatcatgaagatcgggatcggcgtgctcctgacgtggatcgggctgaacagcaagaacacctccatgagcttctcctgcatcgtgatcggcatcatcaccctctacctgggggccgtcgtgcaggccgacatgggctgcgtgatcaactggaagggcaaggagctgaagtgcgggagcggcatcttcgtcaccaacgaggtgcacacgtggaccgagcagtacaagttccaggccgactcccccaagcgcctcgcgaccgccatcgccggggcctgggagaacggcgtgtgcgggatccgcagcaccacgcggatggagaacctgctgtggaagcagatcgccaacgagctcaactacatcctgtgggagaacaacatcaagctgaccgtcgtggtgggcgacatcatcggcgtcctcgagcaggggaagcgcaccctgacgccccagccgatggagctgaagtactcctggaagacgtggggcaaggcgaagatcgtgaccgccgagacccagaacagctccttcatcatcgacgggcccaacacccccgagtgccccagcgcctcccgggcctggaacgtgtgggaggtcgaggactacggcttcggcgtgttcacgaccaacatctggctcaagctgcgcgaggtgtacacccagagctgcgaccaccggctgatgagcgcggccatcaaggacgagcgcgccgtccacgccgacatggggtactggatcgagtcccagaagaacggcagctggaagctcgagaaggcctccttcatcgaggtgaagacctgcacctggcccaagagccacacgctgtggtccaacggggtgctggagagcgacatgatcatccccaagtccctcgcgggccccatcagccagcacaaccaccggccggggtaccacacccagaccgccggcccctggcacctgggcaagctggagctcgacttcaactactgcgaggggaccacggtcgtgatcaccgagaactgcggcacccgcgggccctccctgcggaccacgaccgtgagcggcaagctgatccacgagtggtgctgccgctcctgcaccctgccgcccctgcggtacatgggggaggacggctgctggtacggcatggagatccgccccatcaacgagaaggaggagaacatggtcaagagcctggtgtccgccgggagcggcaaggtggacaacttcaccatgggggtcctctgcctggccatcctgttcgaggaggtgatgcggggcaagttcgggaagaagcacatgatcgccggcgtcctcttcacgttcgtcctgctgctctccggccagatcacctggcgcgacatggcgcacaccctgatcatgatcgggagcaacgcctccgaccggatgggcatgggggtgacctacctggccctcatcgccacgttcaagatccagcccttcctggccctgggcttcttcctccgcaagctgaccagccgggagaacctgctcctgggcgtggggctggcgatggccaccaccctccagctgcccgaggacatcgagcagatggccaacggcatcgccctggggctcatgacgctgaagctgatcacccagttcgagacctaccagctctggaccgcgctggtcagcctgacgtgctccaacaccatcttcaccctcaccgtggcctggcgcacggccaccctgatcctggccggcgtcagcctcctgcccctgtgccagtccagctccatgcggaagaccgactggctccccatgaccgtggccgcgatgggggtgccgcccctcccgctgttcatcttcagcctcaaggacacgcccaagcgccgctcctggcccctgaacgagggcgtcatggccgtgggcctggtgagcatcctcgcctccagcctgctgcggaacgacgtccccatggccgggccgctcgtggccggcgggctgctgatcgcgtgctacgtgatcaccggcacctccgccgacctcaccgtcgagaaggccgccgacgtgacgtgggaggaggaggccgagcagaccggggtgagccacaacctgatgatcaccgtcgacgacgacggcaccatgcgcatcaaggacgacgagaccgagaacatcctgacggtgctcctgaagaccgcgctgctcatcgtgtccggcatcttcccctacagcatccccgccaccctgctggtctggcacacctggcagaagcagacgcagcggtccggggtgctctgggacgtgcccagcccgcccgagacccagaaggccgagctggaggagggcgtctaccgcatcaagcagcaggggatcttcggcaagacccaggtgggggtgggcgtccagaaggagggcgtgttccacaccatgtggcacgtgacgcgcggggccgtcctgacccacaacggcaagcgcctcgagcccaactgggcctccgtgaagaaggacctgatcagctacgggggcgggtggcggctgtccgcgcagtggcagaagggcgaggaggtgcaggtcatcgccgtggagcccggcaagaacccgaagaacttccagaccatgcccgggatcttccagaccacgaccggcgagatcggggccatcgccctggacttcaagcccggcaccagcggcagcccgatcatcaaccgcgaggggaaggtggtcggcctctacgggaacggcgtggtgaccaagaacgggggctacgtctccggcatcgcgcagacgaacgccgagcccgacgggcccacccccgagctggaggaggagatgttcaagaagcggaacctgaccatcatggacctccacccgggcagcgggaagacccgcaagtacctgcccgccatcgtgcgggaggccatcaagcgccggctgcgcacgctcatcctggcccccacccgggtggtcgcggccgagatggaggaggccctgaagggcctccccatccgctaccagaccaccgccacgaagtccgagcacaccgggcgggagatcgtggacctgatgtgccacgccaccttcaccatgcgcctgctcagcccggtgcgggtccccaactacaacctgatcatcatggacgaggcgcacttcacggaccccgcctccatcgccgcccgcggctacatcagcacccgggtgggcatgggggaggccgcggccatcttcatgaccgccacgcccccgggcacggccgaggcgttcccccagtccaacgcccccatccaggacgaggagcgcgacatccccgagcgcagctggaactccgggaacgagtggatcaccgacttcgtgggcaagaccgtctggttcgtgccgagcatcaaggccgggaacgacatcgccaactgcctgcggaagaacggcaagaaggtgatccagctctcccgcaagaccttcgacacggagtaccagaagacccggctgaacgactgggacttcctggtcaccaccgacatcagcgagatgggcgccaacttcaaggcggaccgcgtgatcgacccccggcgctgcctcaagcccgtgatcctgacggacgggcccgagcgggtcatcctggccggcccgatgcccgtgaccgccgcctccgccgcgcagcgccgggggcgcgtgggccggaacccccagaaggagaacgaccagtacatcttcaccgggcagcccctcaacaacgacgaggaccacgcccactggaccgaggccaagatgctgctggacaacatcaacaccccggagggcatcatccccgccctcttcgagcccgagcgcgagaagtccgccgcgatcgacggcgagtaccggctgaagggggagtcccgcaagacgttcgtcgagctgatgcggcgcggcgacctccccgtgtggctggcccacaaggtcgccagcgaggggatcaagtacaccgaccggaagtggtgcttcgacggcgagcgcaacaaccagatcctggaggagaacatggacgtggagatctggaccaaggagggcgagcggaagaagctccgcccgcgctggctggacgcccggacctactccgaccccctggcgctcaaggagttcaaggacttcgccgccgggcgcaagagcatcgccctggacctggtgacggagatcggccgggtcccctcccacctcgcccaccgcacccggaacgcgctggacaacctggtgatgctccacaccagcgagcacgggggccgcgcctaccggcacgccgtggaggagctgccggagaccatggagacgctgctcctgctggggctcatgatcctgctgaccggcggcgccatgctgttcctgatcagcgggaagggcatcgggaagacctccatcggcctgatctgcgtcatcgtgagctccgggatgctctggatggccgacgtgcccctgcagtggatcgcgagcgccatcgtcctggagttcttcatgatggtgctcctgatccccgagcccgagaagcagcgcaccccgcaggacaaccagctggcctacgtggtcatcggcatcctcacgctggccgccatcgtggcggccaacgagatgggcctgctcgagaccaccaagcgggacctggggatgtccaaggagcccggcgtggtcagccccacctcctacctggacgtggacctccaccccgccagcgcctggacgctgtacgccgtggcgaccaccgtcatcaccccgatgctgcgccacacgatcgagaactccaccgccaacgtgagcctcgccgccatcgcgaaccaggccgtggtcctgatggggctggacaagggctggcccatctccaagatggacctcggggtgcccctgctggccctcggctgctacagccaggtgaaccccctgaccctgaccgccgccgtcctcctgctggtgacgcactacgcgatcatcggcccggggctccaggccaaggccacccgggaggcccagaagcgcaccgccgcgggcatcatgaagaaccccaccgtggacgggatcatgacgatcgacctggaccccgtcatctacgactccaagttcgagaagcagctgggccaggtgatgctcctggtgctgtgcgccgtccagctcctgctgatgcggaccagctgggccctctgcgaggccctgaccctggccaccggccccatcacgaccctctgggaggggtccccgggcaagttctggaacaccaccatcgcggtgagcatggccaacatcttccgcgggtcctacctggccggcacggggctggccttcagcatcatgaagtccgtgggcaccggccggcgcgggaccggcagccagggggagaccctcggcgagaagtggaagaagaagctgaaccagctgagccggaaggagttcgacctctacaagaagtccgggatcaccgaggtcgaccgcacggaggcgaaggagggcctgaagcggggcgagaccacccaccacgccgtgagccgcgggtccgccaagctgcagtggttcgtggagcggaacatggtcatccccgagggccgcgtgatcgacctcgggtgcggccgcgggggctggagctactactgcgccggcctgaagaaggtgaccgaggtccgggggtacacgaagggcgggcccggccacgaggagcccgtgccgatgtccacctacgggtggaacatcgtgaagctgatgagcggcaaggacgtcttctacctgccgcccgagaagtgcgacaccctcctgtgcgacatcggcgagtccagcccctccccgaccgtggaggagagccgcacgatccgggtgctgaagatggtcgagccctggctcaagaacaaccagttctgcatcaaggtgctgaacccctacatgcccaccgtgatcgagcacctggagcgcctccagcggaagtacgggggcatgctggtccgcaacccgctgtcccggaacagcacccacgagatgtactggatctccaacgggaccggcaacatcgtgagctccgtgaacatggtcagccgcctcctgctgaaccggttcacgatgacccaccgccggcccaccatcgagaaggacgtggacctcggcgccgggacccgccacgtcaacgcggagcccgagacgccgaacatggacgtgatcggcgagcggatcaagcgcatcaaggaggagcactccagcacctggcactacgacgacgagaacccctacaagacctgggcctaccacgggtcctacgaggtgaaggccaccggcagcgccagctccatgatcaacggggtcgtgaagctgctgacgaagccctgggacgtggtccccatggtgacccagatggccatgaccgacaccacgccgttcggccagcagcgggtgttcaaggagaaggtcgacacccgcacgccccggcccatgcccggcacccgcaaggtgatggagatcacggcggagtggctctggcggaccctggggcgcaacaagaagccgcgcctgtgcacccgggaggagttcaccaagaaggtgcgcacgaacgccgccatgggcgccgtcttcaccgaggagaaccagtgggacagcgcccgggcggccgtggaggacgaggagttctggaagctcgtggaccgcgagcgggagctgcacaagctggggaagtgcggctcctgcgtctacaacatgatggggaagcgcgagaagaagctcggcgagttcggcaaggccaaggggagccgggccatctggtacatgtggctgggcgcgcgctacctggagttcgaggccctcgggttcctgaacgaggaccactggttctcccgggagaacagctactccggcgtggagggggagggcctgcacaagctcggctacatcctgcgcgacatcagcaagatccccgggggcgccatgtacgccgacgacaccgccgggtgggacacccggatcacggaggacgacctgcacaacgaggagaagatcacccagcagatggaccccgagcaccgccagctcgcgaacgccatcttcaagctgacctaccagaacaaggtggtcaaggtgcagcggcccaccccgaagggcaccgtgatggacatcatctcccgcaaggaccagcggggcagcgggcaggtcggcacgtacgggctgaacaccttcaccaacatggaggcccagctcgtgcgccagatggagggcgagggggtgctgtccaaggccgacctggagaacccccacctcctggagaagaagatcacccagtggctggagacgaagggcgtcgagcggctcaagcgcatggccatcagcggcgacgactgcgtggtgaagcccatcgacgaccggttcgcgaacgccctgctggccctcaacgacatggggaaggtccgcaaggacatcccccagtggcagccgtccaagggctggcacgactggcagcaggtccccttctgcagccaccacttccacgagctgatcatgaaggacgggcggaagctggtggtcccctgccgcccccaggacgagctcatcggccgcgcccggatctcccagggggccggctggagcctgaaggagaccgcgtgcctgggcaaggcctacgcccagatgtggtccctcatgtacttccaccgccgggacctgcgcctggccagcaacgccatctgctccgcggtgccggtgcactgggtccccaccagccggaccacgtggagcatccacgcccaccaccagtggatgaccaccgaggacatgctcaccgtgtggaaccgcgtgtggatcgaggacaacccctggatggaggacaagacgcccgtcaccacctgggaggacgtgccgtacctggggaagcgggaggaccagtggtgcggctccctgatcgggctcaccagccgcgccacgtgggcccagaacatcctgaccgcgatccagcaggtccggtccctgatcggcgacgaggagttcctcgactacatgcccagcatgaagcgcttccggaaggaggaggagtccgagggggccatctggtga

SEQ ID NO: 10417 - RNA, 9867 nt, synthetic construct
  misc_feature 1..9867: note = derived and/or modified CDS sequence (opt1) from DENV-4__KR922405__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcgcctgggtcatgtacggcacctgcacccagtccggggagcggcgccgggagaagcgcagcgtggccctgaccccgcactccggcatgggcctcgagacgcgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtcttcttcatcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgacgaccatggcccagggcaagcccaccctggacttcgagctcatcaagaccacggccaaggaggtcgccctgctgcggacctactgcatcgaggcgtccatcagcaacatcaccaccgccacgcgctgcccgacccagggggagccctacctcaaggaggagcaggaccagcagtacatctgccggcgcgacatggtggaccggggctgggggaacggctgcggcctgttcgggaagggcggggtggtcacctgcgccaagttctcctgcctgggcaagatcaccgggaacctcgtgcagatcgagaacctggagtacacggtggtcgtgaccgtgcacaacggcgacacccacgccgtcggcaacgacaccagcaaccacggggtgacggccaccatcaccccccgctcccccagcgtcgaggtgaagctgccggactacggcgagctcaccctggactgcgagccccggtccgggatcgacttcaacgagatgatcctgatgaagatgaagacgaagacctggctcgtgcacaagcagtggttcctggacctgcccctcccctggaccaccggcgcggacaccctggaggtccactggaaccacaaggagcgcatggtgacgttcaaggtgccgcacgccaagcggcaggacgtcaccgtgctggggagccaggagggcgccatgcactccgccctcgccggcgcgaccgaggtggacagcggggacggcaaccacatgttcgccgggcacctgaagtgcaaggtccgcatggagaagctgcgcatcaagggcatgagctacaccatgtgctccggcaagttcagcatcgacaaggagatggccgagacgcagcacgggaccaccgtggtgaaggtcaagtacgagggcaccggggccccctgcaaggtgcccatcgagatccgggacgtgaacaaggagaaggtcgtgggccgcatcatctccagcacgcccttcgccgagaacaccaactccgtgaccaacatcgagctcgagccgcccttcggggacagctacatcgtcatcggcgtgggcgactccgcgctgaccctgcactggttccggaaggggagctccatcggcaagatgttcgagagcacgtaccgcggggccaagcggatggccatcctcggcgagaccgcctgggacttcgggtccgtgggcggcctgctgaccagcctcgggaaggcggtccaccaggtgttcggctccgtgtacaccacgatgttcgggggcgtcagctggatggtgcgcatcctgatcgggctgctggtgctctggatcggcaccaactcccggaacaccagcatggccatgtcctgcatcgccgtcggcgggatcaccctgttcctgggcttcacggtgcacgccgacatggggtgcgtggtcagctggtccggcaaggagctcaagtgcgggagcggcatcttcgtgatcgacaacgtgcacacctggaccgagcagtacaagttccagcccgagagccccgcccgcctggcgtccgccatcctgaacgcccacaaggagggcgtctgcgggatccggagcaccacgcgcctcgagaacgtgatgtggaagcagatcaccaacgagctgaactacgtgctgtgggagggcgggcacgacctcaccgtcgtggccggcgacgtgaagggcgtcctgtccaaggggaagcgggccctggcgccgcccgtgaacgacctcaagtacagctggaagacctggggcaaggccaagatcttcacgcccgagacccgcaactccaccttcctggtggacgggcccgacaccagcgagtgcccgaacgagcggcgcgcctggaacttcctggaggtcgaggactacggcttcgggatgttcacgaccaacatctggatgaagttccgggagggctccagcgaggtgtgcgaccaccgcctcatgtccgccgccatcaaggaccagaaggcggtgcacgccgacatgggctactggatcgagagctccaagaaccagacctggcagatcgagaaggccagcctgatcgaggtcaagacctgcctgtggcccaagacgcacaccctctggtccaacggggtgctggagagccagatgctgatccccaaggcctacgcgggcccgatctcccagcacaactaccggcaggggtacgccacccagaccgccggcccctggcacctcgggaagctggagatcgacttcggcgagtgccccggcaccacggtgaccatccaggaggactgcgaccaccgcgggcccagcctgcggaccaccacggcctccggcaagctcgtcacccagtggtgctgccgcagctgcaccatgccgcccctgcgcttcctgggggaggacggctgctggtacgggatggagatccggcccctcaacgagaaggaggagaacatggtgaagagccaggtgtccgccggccagggcaccagcgagacgttctccatggggctgctgtgcctcaccctgttcgtcgaggagtgcctgcgccggcgcgtgacccggaagcacatgatcctcgtcgtggtgaccacgctgtgcgcgatcatcctgggcgggctcacctggatggacctgctgcgcgccctcatcatgctgggcgacaccatgagcggccggatggggggccagatccacctggccatcatggccgtcttcaagatgtcccccgggtacgtgctcggcatcttcctgcgcaagctgaccagccgggagacggccctcatggtgatcgggatggcgatgaccaccgtcctgtccatcccgcacgacctgatggagttcatcgacggcatcagcctcggcctgatcctgctcaagatggtgacccacttcgacaacacgcaggtggggaccctggccctggccctcaccttcatcaagtccaccatgcccctggtcatggcctggcgcacgatcatggccgtgctgttcgtggtcaccctcatccccctgtgccggaccagctgcctgcagaagcagtcccactgggtggagatcaccgcgctcatcctgggcgcccaggccctgcccgtgtacctcatgacgctgatgaagggggccagcaagcgctcctggccgctgaacgagggcatcatggcggtcgggctcgtgagcctgctgggctccgccctcctgaagaacgacgtgcccctggccggccccatggtcgccgggggcctcctgctggccgcgtacgtgatgagcgggtccagcgccgacctctccctggagaaggccgccaacgtgcagtgggacgagatggccgacatcaccggcagcagccccatcatcgaggtcaagcaggacgaggacgggtccttcagcatccgggacgtggaggagaccaacatgatcaccctgctcgtgaagctggcgctgatcacggtctccggcctctacccgctggccatccccgtgaccatgaccctgtggtacatgtggcaggtgaagacccagcgcagcggcgccctctgggacgtcccctcccccgccgccgcgcagaaggccacgctgaccgagggggtgtaccggatcatgcagcgcggcctgttcgggaagacccaggtgggcgtcgggatccacaccgagggcgtgttccacaccatgtggcacgtgacgcggggcagcgtcatctgccacgagtccgggcgcctcgagccgagctgggccgacgtgcggaacgacatgatctcctacggcgggggctggcgcctgggcgacaagtgggacaaggaggaggacgtgcaggtcctggccatcgagcccgggaagaaccccaagcacgtgcagaccaagcccggcctcttcaagaccctgaccggggagatcggcgccgtgacgctggacttcaagccggggaccagcggctcccccatcatcaaccggaagggcaaggtcatcgggctctacggcaacggggtggtgaccaagagcggcgactacgtctccgcgatcacccaggccgagcgcatcggggagcccgactacgaggtggacgaggacatcttccgcaagaagcggctgacgatcatggacctgcacccgggcgccggcaagaccaagcgcatcctgcccagcatcgtgcgggaggccctcaagcgccggctgcgcaccctgatcctcgcgcccacccgggtcgtggccgccgagatggaggaggccctgcgcgggctgcccatccggtaccagacgccggccgtgaagtccgagcacaccggccgcgagatcgtcgacctcatgtgccacgcgaccttcaccacgcggctgctgagctccacccgcgtgcccaactacaacctcatcgtgatggacgaggcccacttcaccgaccccagctccgtcgccgcccgggggtacatcagcacccgcgtggagatgggcgaggccgcggccatcttcatgacggccacccccccggggaccaccgaccccttcccccagagcaactcccccatcgaggacatcgagcgggagatcccggagcgcagctggaacacgggcttcgactggatcaccgactaccagggcaagaccgtctggttcgtgccctccatcaaggccgggaacgacatcgccaactgcctgcggaagagcggcaagaaggtgatccagctgtcccgcaagaccttcgacacggagtaccccaagaccaagctcaccgactgggacttcgtcgtgaccacggacatcagcgagatgggggcgaacttccgggccggccgcgtgatcgacccccgccggtgcctgaagccggtcatcctgaccgacgggcccgagcgcgtgatcctcgccggccccatccccgtgaccccggcctccgcggcccagcggcgcggccggatcgggcgcaaccccgcccaggaggacgaccagtacgtcttcagcggcgaccccctgcggaacgacgaggaccacgcccactggaccgaggccaagatgctgctcgacaacatctacacgcccgaggggatcatcccgaccctgttcggccccgagcgcgagaagacccaggcgatcgacggcgagttccggctgcgcggggagcagcggaagaccttcgtggagctcatgcgccggggcgacctgcccgtgtggctgtcctacaaggtcgccagcgccgggatctcctacaaggaccgcgagtggtgcttcacgggcgagcggaacaaccagatcctcgaggagaacatggaggtggagatctggacccgcgagggggagaagaagaagctgcggcccaagtggctggacgcccgcgtgtacgccgacccgatggcgctcaaggacttcaaggagttcgccagcggccggaagtccatcaccctggacatcctgaccgagatcgccagcctccccatgtacctgtccagccgcgccaagctggccctcgacaacatcgtcatgctgcacaccacggagcggggcgggaaggcgtaccagcacgccctgaacgagctccccgagtccctggagaccctgatgctcgtggccctgctgggcgccatgaccgcggggatcttcctcttcttcatgcagggcaaggggatcggcaagctgagcatgggcctgatcgccatcgccgtggcctccgggctcctgtgggtcgccgagatccagccgcagtggatcgcggccagcatcatcctggagttcttcctcatggtgctgctggtgcccgagcccgagaagcagcgcaccccccaggacaaccagctcatctacgtcatcctgacgatcctgaccatcatcgccctcgtggccgccaacgagatgggcctgatcgagaagaccaagaccgacttcgggttctaccaggtgaaggcggagacgaccatcctggacgtcgacctccgcccggccagcgcctggaccctgtacgccgtggccaccacgatcctgacccccatgctccggcacaccatcgagaacacctccgcgaacctgagcctggccgccatcgccaaccaggccgcggtgctcatgggcctggggaagggctggcccctgcaccgcatggacctcggcgtccccctgctggccatggggtgctactcccaggtgaacccgacgaccctcaccgccagcctggtgatgctgctcgtccactacgccatcatcggccccgggctgcaggcgaaggccacccgggaggcccagaagcgcacggccgccggcatcatgaagaaccccaccgtggacggcatcaccgtgatcgacctggagcccatctcctacgacccgaagttcgagaagcagctcgggcaggtcatgctgctggtgctctgcgcgggccagctgctgctcatgcggaccacgtgggccttctgcgaggtgctgaccctggccaccgggcccatcctcaccctgtgggagggcaaccccgggcgcttctggaacacgaccatcgccgtcagcaccgccaacatcttccggggctcctacctggcgggcgccgggctcgccttcagcctgatcaagaacgcccagaccccccgccggggcacggggaccaccggcgagaccctgggggagaagtggaagcgccagctcaactccctggaccggaaggagttcgaggagtacaagcgcagcggcatcctggaggtggaccggacggaggccaagtccgcgctcaaggacggcagcaagatcaagttcgccgtgtcccgcgggaccagcaagatccggtggatcgtcgagcgcggcatggtgaagccgaaggggaaggtggtcgacctgggctgcgggcggggcggctggtcctactacatggccaccctgaagaacgtgaccgaggtgaaggggtacaccaagggcgggcccggccacgaggagcccgtccccatggccacgtacgggtggaacctcgtgaagctgcacagcggcgtggacgtcttctacaagccgaccgagcaggtggacaccctgctctgcgacatcggcgagtccagctccaaccccaccatcgaggaggggcgcacgctgcgggtgctgaagatggtcgagccctggctgagcagcaagcccgagttctgcatcaaggtgctcaacccgtacatgcccaccgtcatcgaggagctggagaagctgcagcgccgccacggcgggtccctcgtgcggtgccccctgagccgcaactccacccacgagatgtactgggtgagcggcgtctccggcaacatcgtgagctccgtgaacaccacgagcaagatgctgctcaaccggttcaccacccgccaccggaagcccacctacgagaaggacgcggacctgggggccggcacgcgctccgtcagcaccgagaccgagaagccggacatgaccatcatcgggcggcgcctgcagcggctccaggaggagcacaaggagacgtggcactacgaccacgagaacccctaccgcacctgggcctaccacggctcctacgaggcccccagcaccgggtccgccagctccatggtgaacggcgtggtcaagctgctgaccaagccgtgggacgtggtgcccatggtcacgcagctcgcgatgaccgacaccacccccttcggccagcagcgggtgttcaaggagaaggtggacacgcgcaccccccagccgaagcccgggacccgggtcatcatgaccacgaccgccaactggctgtggaccctgctcggccgcaagaagaacccccggctgtgcacccgcgaggagttcatcagcaaggtgcggtccaacgccgccatcggggccgtgttccaggaggagcagggctggacgagcgcgtccgaggccgtcaacgacagccgcttctgggagctggtggacaaggagcgggccctccaccaggaggggaagtgcgagagctgcgtgtacaacatgatgggcaagcgcgagaagaagctgggcgagttcgggcgggccaagggctcccgcgccatctggtacatgtggctgggggcgcgcttcctcgagttcgaggccctgggcttcctgaacgaggaccactggttcgggcgggagaacagctggtccggcgtcgagggcgaggggctccaccgcctgggctacatcctggaggacatcgacaagaaggacggggacctcatctacgccgacgacaccgccggctgggacacccggatcaccgaggacgacctgctgaacgaggagctcatcacggagcagatggcgccccaccacaagatcctggccaaggccatcttcaagctgacctaccagaacaaggtggtgaaggtcctccgcccgacccccaagggcgccgtgatggacatcatcagccggaaggaccagcgcgggtccggccaggtggggacctacggcctgaacaccttcacgaacatggaggtccagctgatccggcagatggaggccgagggggtgatcacccaggacgacatgcacaaccccaagggcctcaaggagcgcgtggagaagtggctgaaggagtgcggcgtcgaccggctgaagcgcatggcgatcagcggggacgactgcgtggtgaagcccctcgacgagcggttctccaccagcctgctgttcctcaacgacatgggcaaggtccgcaaggacatcccgcagtgggagccctccaaggggtggaagaactggcaggaggtgcccttctgcagccaccacttccacaagatcttcatgaaggacggccggtccctggtggtcccctgccgcaaccaggacgagctgatcgggcgggcccgcatcagccagggcgccggctggtccctccgggagaccgcctgcctggggaaggcctacgcgcagatgtggagcctgatgtacttccaccgccgggacctccgcctggcctccatggccatctgcagcgccgtgccgacggagtggttccccacctcccgcaccacctggagcatccacgcccaccaccagtggatgacgaccgaggacatgctgaaggtgtggaaccgggtctggatcgaggacaaccccaacatgatcgacaagacccccgtgcacagctgggaggacatcccgtacctcggcaagcgcgaggacctgtggtgcgggtccctgatcggcctcagctcccgggcgacctgggccaagaacatccacacggccatcacccaggtgcgcaacctgatcgggaaggaggagtacgtcgactacatgcccgccatgcggcgctacagcgcccacttcgagtccgagggcgtgctgtga

SEQ ID NO: 10418 - RNA, 9867 nt, synthetic construct
  misc_feature 1..9867: note = derived and/or modified CDS sequence (opt1) from DENV-4__KP188557__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggcccggatcttcacccccgaggcccgcaacaacacgttcctgatcgacgggcccgacaccagcgagtgcccgaacgagcggcgcgcctggaactccttcgaggtggaggactacggcttcgggatgttcaccaccaacatctggatgaagttccgggagggcagctccgaggtgtgcgaccaccgcctcatgagcgcggccatcaaggaccagaaggccgtccacgccgacatgggctactggatcgagtccagcaagaaccagacgtggcagatcgagcgggcgtccctgatcgaggtgaagacctgcctgtggcccaagacccacaccctctggagcaacggggtgctggagtcccagatgctgatccccaagagctacgccggcccgttctcccagcacaactaccgccaggggtacgccacccagacggtcggcccctggcacctcgggaagctggagatcgacttcggcgagtgccccggcaccaccgtgaccatccaggagaactgcgaccaccgcgggcccagcctgcggacgaccaccgcctccggcaagctcgtgacccagtggtgctgccgcagctgcacgatgccgcccctgcggttcctgggggaggacggctgctggtacgggatggagatccgccccctcagcgagaaggaggagaacatggtcaagtcccaggtgaccgccggccagggcaccagcgagaccttctccatggggctgctgtgcctcacgctgttcgtcgaggagtgcctgcggcgccgggtgacccgcaagcacatgatcctcgcggtggtcatcaccctgtgcgccatcatcctgggcgggctcacctggatggacctgctgcgggccctcatcatgctgggcgacacgatgagcggccgcatcgggggccagacccacctggccatcatggccgtgttcaagatgtcccccgggtacgtgctcggcgtcttcctgcggaagctgaccagccgcgagaccgcgctcatggtgatcgggatggccatgacgaccaccctgtccatcccgcacgacctgatggagctcatcgacggcatcagcctgggcctgatcctcctgaagatcgtgacccagttcgacaacacgcaggtcgggaccctggccctctccctgaccttcatccggagcaccatgtccctggtgatggcctggcgcacgatcatggccgtgctcttcgtcgtgaccctgatccccctgtgccggaccagctgcctccagaagcagtcccactgggtggagatcaccgcgctgatcctgggcgcccaggccctccccgtctacctgatgacgctgatgaagggggccagccgccggtcctggcccctcaacgagggcatcatggcggtggggctggtgagcctgctcggctccgccctgctgaagaacgacgtcccgctcgccggccccatggtggccgggggcctgctgctcgccgcgtacgtgatgagcgggtccagcgccgacctgagcctggagaaggccgccaacgtccgctgggacgagatggccgacatcaccggctccagccccatcatcgaggtgaagcaggacgaggacgggtccttcagcatccgggacgtggaggagaccaacatgatcaccctcctggtcaagctggcgctcatcacggtgtccggcctgtaccccctggccatcccgatcaccatgaccctctggtacatgtggcaggtgaagacccagcgcagcggcgccctgtgggacgtcccctcccccgccgccacccagaaggcggccctgagcgagggggtgtaccggatcatgcagcgcggcctcttcgggaagacgcaggtgggcgtcgggatccacatggagggcgtgttccacaccatgtggcacgtgacccgcggctccgtcatctgccacgagaccgggcggctggagcccagctgggccgacgtgcgcaacgacatgatctcctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgagcggctccccgatcatcaaccgcaagggcaaggtcatcgggctgtacggcaacggggtggtgaccaagagcggcgactacgtctccgcgatcacccaggccgagcggatcggggagcccgactacgaggtggacgaggacatcttccgcaagaagcggctgaccatcatggacctccaccccggcgccggcaagacgaagcgcatcctgccgagcatcgtgcgggaggccctgaagcgccggctgcgcaccctcatcctggcgcccacccgggtcgtggccgccgagatggaggaggccctgcgcgggctccccatccggtaccagacccccgccgtgaagtccgagcacacgggccgcgagatcgtcgacctgatgtgccacgcgaccttcaccacccggctgctcagctccacgcgcgtgccgaactacaacctgatcgtgatggacgaggcccacttcaccgaccccagcagcgtcgccgcccgggggtacatctccacccgcgtggagatgggcgaggccgcggccatcttcatgaccgccacgccccccggggccaccgacccgttcccccagagcaactcccccatcgaggacatcgagcgcgagatccccgagcggagctggaacaccggcttcgactggatcaccgactaccagggcaagacggtctggttcgtgccgtccatcaaggccgggaacgacatcgcgaactgcctgcgcaagagcggcaagaaggtgatccagctctcccggaagaccttcgacaccgagtaccccaagaccaagctgacggactgggacttcgtcgtgaccaccgacatcagcgagatgggggccaacttccgcgccggccgggtgatcgacccccgccggtgcctgaagcccgtcatcctcaccgacgccccggagcgcgtgatcctggcggggcccatccccgtgacgcccgcctccgccgcccagcggcgcggccggatcggccgcaacccggcccaggaggacgaccagtacgtcttcagcggggaccccctgaagaacgacgaggaccacgcgcactggaccgaggccaagatgctcctggacaacatctacacccccgagggcatcatccccaccctgttcgggccggagcgggagaagacgcaggccatcgacggcgagttccgcctccggggcgagcagcgcaagaccttcgtggagctgatgcggcgcggggacctgcccgtgtggctctcctacaaggtcgccagcgccggcatctcctacaaggaccgggagtggtgcttcaccggggagcgcaacaaccagatcctggaggagaacatggaggtggagatctggacccgggagggcgagaagaagaagctgcgccccaagtggctcgacgcgcgcgtgtacgccgaccccatggccctgaaggacttcaaggagttcgccagcgggcggaagtccatcaccctggacatcctcacggagatcgccagcctgccgacctacctgtccagccgcgcgaagctcgccctggacaacatcgtcatgctgcacaccaccgagcggggcggccgcgcctaccagcacgccctcaacgagctgcccgagtccctggagacgctcatgctggtggcgctgctcggggccatgaccgccggcatcttcctgttcttcatgcaggggaagggcatcgggaagctgagcatgggcctcatcaccatcgccgtggccagcggcctgctgtgggtcgcggagatccagccccagtggatcgccgcctccatcatcctcgagttcttcctgatggtgctgctcatcccggagcccgagaagcagcggaccccccaggacaaccagctgatctacgtgatcctgacgatcctcaccatcatcgggctgatcgccgccaacgagatgggcctgatcgagaagaccaagaccgacttcgggttctaccaggtcaagacggagaccaccatcctcgacgtggacctgcgccccgcgagcgcctggaccctgtacgccgtggccacgaccatcctcaccccgatgctgcggcacaccatcgagaacacgtccgccaacctgagcctcgcggccatcgccaaccaggccgccgtcctgatgggcctggggaagggctggcccctccaccgcatggacctgggcgtgcccctgctcgcgatggggtgctactcccaggtgaaccccaccaccctgaccgccagcctggtcatgctcctggtgcactacgccatcatcggcccggggctgcaggccaaggcgacgcgggaggcccagaagcgcaccgccgccggcatcatgaagaaccccaccgtggacggcatcaccgtcatcgacctcgagcccatctcctacgaccccaagttcgagaagcagctggggcaggtgatgctgctcgtgctgtgcgccggccagctgctcctgatgcggacgacctgggcgttctgcgaggtcctgaccctcgccaccgggccgatcctgacgctgtgggagggcaaccccgggcgcttctggaacaccaccatcgccgtgagcaccgccaacatcttccggggctcctacctcgccggcgcggggctggccttcagcctgatcaagaacgcccagacgccccgccggggcaccgggaccgccggcgagaccctcggggagaagtggaagcgccagctgaactccctggaccggaaggagttcgaggagtacaagcgcagcggcatcctcgaggtggaccggaccgaggccaagtccgcgctgaaggacggcagcaagatcaagcacgccgtctcccgcgggagctccaagatccgctggatcgtggagcggggcatggtgaagcccaaggggaaggtcgtggacctgggctgcgggcgcggcggctggagctactacatggccacgctcaagaacgtgaccgaggtcaaggggtacaccaagggcgggccgggccacgaggagcccatccccatggccacctacgggtggaacctggtgaagctgcactccggcgtggacgtcttctacaagcccacggagcaggtggacaccctcctgtgcgacatcggcgagagcagctccaacccgaccatcgaggaggggcggaccctgcgcgtgctcaagatggtcgagccctggctgagctccaagcccgagttctgcatcaaggtgctgaacccctacatgccgacggtgatcgaggagctggagaagctccagcggaagcacggcgggaacctggtccgctgccccctgagccggaactccacccacgagatgtactgggtgagcggcgcgtccggcaacatcgtcagctccgtgaacaccaccagcaagatgctcctgaaccgcttcacgacccggcaccgcaagcccacctacgagaaggacgtggacctgggggccggcacccggtccgtcagcacggagaccgagaagcccgacatgaccatcatcgggcgccggctccagcgcctgcaggaggagcacaaggagacctggcactacgaccaggagaacccgtaccggacgtgggcctaccacggctcctacgaggcccccagcaccgggtccgccagctccatggtgaacggcgtggtcaagctgctcaccaagccctgggacgtgatcccgatggtgacccagctggcgatgacggacaccacccccttcggccagcagcgcgtcttcaaggagaaggtggacacccggacgccccagcccaagccggggacccgcatggtgatgaccaccacggccaactggctgtgggccctcctgggcaagaagaagaacccccggctgtgcacccgcgaggagttcatcagcaaggtccggtccaacgccgccatcggggcggtgttccaggaggagcagggctggaccagcgccagcgaggccgtgaacgactcccgcttctgggagctcgtcgacaaggagcgcgccctgcaccaggaggggaagtgcgagagctgcgtgtacaacatgatgggcaagcgggagaagaagctgggcgagttcgggcgcgccaagggctcccgggcgatctggtacatgtggctcggggcccgcttcctggagttcgaggccctgggcttcctcaacgaggaccactggttcgggcgggagaacagctggtccggcgtggagggcgaggggctgcaccgcctgggctacatcctcgaggagatcgacaagaaggacggggacctgatgtacgccgacgacaccgcgggctgggacacgcggatcaccgaggacgacctgcagaacgaggagctcatcaccgagcagatggccccccaccacaagatcctggccaaggccatcttcaagctgacctaccagaacaaggtcgtgaaggtgctccgccccaccccgcggggcgccgtcatggacatcatcagccgcaaggaccagcgggggtccggccaggtggggacgtacggcctgaacaccttcaccaacatggaggtgcagctgatccgccagatggaggcggagggggtcatcacccaggacgacatgcagaaccccaagggcctcaaggagcgggtggagaagtggctgcgcgagtgcggcgtggaccggctgaagcgcatggccatcagcggggacgactgcgtcgtgaagcccctcgacgagcggttcggcacgtccctgctgttcctcaacgacatggggaaggtgcgcaaggacatcccccagtgggagccgagcaagggctggaagaactggcaggaggtccccttctgctcccaccacttccacaagatcttcatgaaggacgggcggagcctggtggtgccctgccgcaaccaggacgagctgatcggccgcgcccggatctcccagggcgccgggtggagcctccgcgagaccgcctgcctgggcaaggcgtacgcccagatgtggtccctgatgtacttccaccggcgcgacctccggctggccagcatggccatctgctccgccgtccccaccgagtggttcccgaccagccgcacgacctggagcatccacgcgcaccaccagtggatgaccaccgaggacatgctgaaggtgtggaaccgggtgtggatcgaggacaaccccaacatgatcgacaagacgcccgtccactcctgggaggacatcccctacctcgggaagcgcgaggacctgtggtgcggcagcctgatcgggctctccagccgggccacctgggccaagaacatccacaccgccatcacccaggtgcgcaacctgatcggcaaggaggagtacgtggactacatgccggtcatgaagcggtactccgcccccagcgagtccgagggcgtgctgtga

SEQ ID NO: 10419 - RNA, 9867 nt, synthetic construct
  misc_feature 1..9867: note = derived and/or modified CDS sequence (opt1) from DENV-4__KP188558__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacgacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatcagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacgtacgggctgaacaccttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggacgagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtccccaccgagtggttcccgaccagccgcacgacctggtccatccacgcccaccaccagtggatgaccaccgaggacatgctgaaggtgtggaaccgggtgtggatcgaggacaaccccaacatgatcgacaagacgcccgtccacagctgggaggacatcccctacctcggcaagcgcgaggacctgtggtgcgggtccctgatcggcctcagctcccgggcgacctgggccaagaacatccacaccgccatcacccaggtgcgcaacctgatcggcaaggaggagtacgtggactacatgccggtcatgaagcggtacagcgccccctccgagagcgagggggtgctgtga

SEQ ID NO: 10420 - RNA, 9867 nt, synthetic construct
  misc_feature 1..9867: note = derived and/or modified CDS sequence (opt1) from DENV-4__KP188563__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatcgccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggaccgcgaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccggaagggcaaggtcatcgggctgtacggcaacggggtggtgaccaagtccggcgactacgtcagcgcgatcacccaggccgagcgcatcggggagcccgactacgaggtggacgaggacatcttccggaagaagcgcctgaccatcatggacctccaccccggcgccggcaagacgaagcggatcctgccgtccatcgtgcgcgaggccctgaagcggcgcctgcggaccctcatcctggcgcccacccgcgtcgtggccgccgagatggaggaggccctgcgggggctccccatccgctaccagacccccgccgtgaagagcgagcacacgggccgggagatcgtcgacctgatgtgccacgcgaccttcaccacccgcctgctctccagcacgcgggtgccgaactacaacctgatcgtgatggacgaggcccacttcaccgaccccagctccgtcgccgcccgcgggtacatcagcacccgggtggagatgggcgaggccgcggccatcttcatgaccgccacgccccccggggccaccgacccgttcccccagtccaacagccccatcgaggacatcgagcgcgagatccccgagcgctcctggaacaccggcttcgactggatcaccgactaccagggcaagacggtctggttcgtgccgagcatcaaggccgggaacgacatcgcgaactgcctgcggaagtccggcaagaaggtgatccagctcagccgcaagaccttcgacaccgagtaccccaagaccaagctgacggactgggacttcgtcgtgaccaccgacatctccgagatgggggccaacttccgggccggccgcgtgatcgacccccggcgctgcctgaagcccgtcatcctcaccgacgggccggagcgggtgatcctggccggccccatccccgtgacgcccgcgagcgccgcccagcgccggggccgcatcgggcggaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgcgagaagacgcaggccatcgacggcgagttccggctccgcggggagcagcggaagaccttcgtggagctgatgcgccggggcgacctgcccgtgtggctcagctacaaggtcgcctccgccgggatcagctacaaggaccgcgagtggtgcttcaccggcgagcggaacaaccagatcctggaggagaacatggaggtggagatctggacccgcgagggggagaagaagaagctgcggcccaagtggctcgacgcccgcgtgtacgcggaccccatggccctgaaggacttcaaggagttcgcctccggccgcaagagcatcaccctggacatcctcacggagatcgcctccctgccgacctacctgagctcccgggccaagctcgcgctggacaacatcgtcatgctgcacaccaccgagcgcggcgggcgggcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcgcaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcggcccgcctccgcgtggaccctgtacgccgtggccacgaccatcctcaccccgatgctgcgccacaccatcgagaacacgagcgccaacctgtccctcgccgcgatcgccaaccaggccgccgtcctgatggggctgggcaagggctggcccctccaccggatggacctgggggtgcccctgctcgccatgggctgctacagccaggtgaaccccaccaccctgaccgcgtccctggtcatgctcctggtgcactacgccatcatcgggccgggcctgcaggccaaggccacgcgcgaggcgcagaagcggaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcgcacgacctgggccttctgcgaggtcctgaccctcgcgaccggcccgatcctgacgctgtgggaggggaaccccggccggttctggaacaccaccatcgccgtgtccaccgccaacatcttccgcggcagctacctcgccggggccggcctggcgttctccctgatcaagaacgcccagacgccccggcgcgggaccggcaccgccggggagaccctcggcgagaagtggaagcggcagctgaacagcctggaccgcaaggagttcgaggagtacaagcggtccggcatcctcgaggtggaccgcaccgaggccaagagcgccctgaaggacgggtccaagatcaagcacgcggtcagccggggctccagcaagatccgctggatcgtggagcgcgggatggtgaagcccaagggcaaggtcgtggacctggggtgcggccggggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccgcaccctgcgggtgctcaagatggtcgagccctggctgtccagcaagcccgagttctgcatcaaggtgctgaacccctacatgccgacggtgatcgaggagctggagaagctccagcgcaagcacgggggcaacctggtccggtgccccctgtcccgcaacagcacccacgagatgtactgggtgtccggcgccagcgggaacatcgtctccagcgtgaacaccacctccaagatgctcctgaaccggttcacgacccgccaccggaagcccacctacgagaaggacgtggacctgggcgcggggacccgcagcgtctccacggagatcgagaagcccgacatgaccatcatcggccggcgcctccagcggctgcaggaggagcacaaggagacctggcactacgaccaggagaacccgtaccgcacctgggcctaccacgggagctacgaggccccctccacgggcagcgcctccagcatggtgaacggcgtggtcaagctgctcaccaagccctgggacgtgatcccgatggtgacccagctggccatgaccgacacgacccccttcgggcagcagcgggtcttcaaggagaaggtggacacccgcaccccccagcccaagccgggcacgcggatggtgatgaccaccaccgcgaactggctgtgggccctcctggggaagaagaagaacccccgcctgtgcacgcgggaggagttcatctccaaggtccgcagcaacgccgccatcggcgccgtgttccaggaggagcaggggtggaccagcgcgtccgaggccgtgaacgacagccggttctgggagctcgtcgacaaggagcgcgccctgcaccaggagggcaagtgcgagtcctgcgtgtacaacatgatgggcaagcgcgagaagaagctgggggagttcggccgggccaaggggagccgcgccatctggtacatgtggctcggcgcgcggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgccgacgacaccgccggctgggacacccgcatcacggaggacgacctgcagaacgaggagctcatcaccgagcagatggcgccccaccacaagatcctggccaaggccatcttcaagctgacctaccagaacaaggtcgtgaaggtgctccggcccaccccgcgcggggccgtcatggacatcatctcccggaaggaccagcgcggcagcgggcaggtgggcacctacgggctgaacacgttcaccaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggcgatctccggcgacgactgcgtcgtgaagcccctcgacgagcgcttcgggaccagcctgctgttcctcaacgacatgggcaaggtgcggaaggacatcccccagtgggagccgtccaaggggtggaagaactggcaggaggtccccttctgcagccaccacttccacaagatcttcatgaaggacggccgctccctggtggtgccctgccggaaccaggacgagctgatcggccgcgcccgcatcagccagggggccggctggtccctccgggagacggcctgcctggggaaggcctacgcgcagatgtggagcctgatgtacttccaccgccgggacctccgcctggcctccatggccatctgcagcgccgtccccaccgagtggttcccgaccagccggaccacgtggtccatccacgcccaccaccagtggatgaccaccgaggacatgctgaaggtgtggaaccgcgtgtggatcgaggacaaccccaacatgatcgacaagacccccgtccacagctgggaggacatcccctacctcggcaagcgggaggacctgtggtgcgggtccctgatcggcctcagctcccgcgcgacgtgggccaagaacatccacaccgccatcacccaggtgcggaacctgatcggcaaggaggagtacgtggactacatgagcgtcatgaagcgctactccgccccgagcgagtccgagggggtgctgtga

SEQ ID NO: 10421 - RNA, 9867 nt, synthetic construct
  misc_feature 1..9867: note = derived and/or modified CDS sequence (opt1) from DENV-4__KP188564__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatcgcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaagatcaagtacgagggcgccggggccccctgcaaggtgcccatcgagatccgggacgtcaacaaggagaaggtggtgggccgcgtcatcagcgccacgcccctggcggagaacaccaactccgtgaccaacatcgagctcgagccgcccttcggggacagctacatcgtgatcggcgtcggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtgcaccaggtcttcggctccgtgtacaccacgatgttcgggggcgtgagctggatgatccgcatcctcatcgggttcctggtcctgtggatcggcaccaactcccggaacaccagcatggccatgacctgcatcgccgtgggcgggatcacgctgttcctcggcttcaccgtgcaggccgacatggggtgcgtcgtgtcctggagcggccgcgagctgaagtgcgggtccggcatcttcgtggtcgacaacgtgcacacctggaccgagcagtacaagttccagcccgagagccccgcgcggctggccagcgccatcctcaacgcccacaaggacggcgtgtgcgggatccgctccacgacccggctggagaacgtcatgtggaagcagatcaccaacgagctgaactacgtgctctgggagggcgggcacgacctgaccgtggtcgccggcgacgtgaagggcgtgctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtcgaggactacggcttcgggatgttcaccaccaacatctggatgaagttccgcgagggctccagcgaggtgtgcgaccaccggctcatgtccgcggccatcaaggaccagaaggccgtgcacgccgacatgggctactggatcgagagctccaagaaccagacgtggcagatcgagcgcgcgagcctgatcgaggtcaagacctgcctgtggcccaagacccacaccctctggtccaacggggtgctggagagccagatgctgatccccaagtcctacgccggcccgttcagccagcacaactaccggcaggggtacgccacccagacggtgggcccctggcacctcgggaagctggagatcgacttcggcgagtgccccggcaccaccgtcaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtgaagagccaggtcaccgccggccagggcacctccgagaccttcagcatggggctgctgtgcctcacgctgttcgtggaggagtgcctgcgccggcgcgtcacccggaagcacatgatcctcgcggtggtgatcaccctgtgcgccatcatcctgggcgggctcacctggatggacctgctgcgcgccctcatcatgctgggcgacacgatgtccggccggatcgggggccagacccacctggccatcatggccgtcttcaagatgagccccgggtacgtgctcggcgtgttcctgcgcaagctgacctcccgggagaccgcgctcatggtcatcgggatggccatgacgaccaccctgagcatcccgcacgacctgatggagctcatcgacggcatctccctgggcctgatcctcctgaagatcgtgacccagttcgacaacacgcaggtggggaccctggccctcagcctgaccttcatccgctccaccatgagcctggtcatggcctggcggacgatcatggccgtgctcttcgtggtcaccctgatccccctgtgccgcacctcctgcctccagaagcagagccactgggtggagatcaccgcgctgatcctgggcgcccaggccctccccgtgtacctgatgacgctgatgaagggggcctcccggcgcagctggcccctcaacgagggcatcatggcggtcgggctggtgtccctgctcggcagcgccctgctgaagaacgacgtgccgctcgccggccccatggtcgccgggggcctgctgctcgccgcgtacgtgatgtccgggagcagcgccgacctgtccctggagaaggccgccaacgtgcagtgggacgagatggccgacatcaccggcagctcccccatcatcgaggtcaagcaggacgaggacgggagcttctccatccgggacgtggaggagaccaacatgatcaccctcctggtgaagctggcgctcatcacggtcagcggcctgtaccccctggccatcccgatcaccatgaccctctggtacatgtggcaggtgaagacccagcgctccggcgccctgtgggacgtgcccagccccgccgccacccagaaggcggccctgtccgagggggtctaccggatcatgcagcgcggcctcttcgggaagacgcaggtgggcgtggggatccacatggagggcgtcttccacaccatgtggcacgtgacccggggcagcgtgatctgccacgagaccgggcgcctggagccctcctgggccgacgtccgcaacgacatgatcagctacggcgggggctggcggctgggcgacaagtgggacaaggaggaggacgtgcaggtgctcgccatcgagccggggaagaaccccaagcacgtccagacgaagcccggcctgttcaagaccctgaccggggagatcggcgccgtgaccctcgacttcaagcccgggacgtccggcagcccgatcatcaaccgcaagggcaaggtgatcgggctgtacggcaacggggtcgtgaccaagtccggcgactacgtgagcgcgatcacccaggccgagcggatcggggagcccgactacgaggtcgacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtggtcgccgccgagatggaggaggccctgcgcgggctccccatccggtaccagacccccgccgtgaagagcgagcacacgggccgcgagatcgtggacctgatgtgccacgcgaccttcaccacccggctgctctccagcacgcgcgtcccgaactacaacctgatcgtgatggacgaggcccacttcaccgaccccagctccgtggccgcccgggggtacatcagcacccgcgtcgagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtcccgagcatcaaggccgggaacgacatcgcgaactgcctgcgcaagtccggcaagaaggtgatccagctcagccggaagaccttcgacaccgagtaccccaagaccaagctgacggactgggacttcgtggtcaccaccgacatctccgagatgggggccaacttccgcgccggccgggtgatcgacccccgccggtgcctgaagcccgtgatcctcaccgacgggccggagcgcgtcatcctggccggccccatccccgtgacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtcgagctgatgcggcgcggcgacctgcccgtgtggctcagctacaaggtggcctccgccgggatcagctacaaggaccgggagtggtgcttcaccggcgagcgcaacaaccagatcctggaggagaacatggaggtcgagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtcgccctgctcggcgcgatgaccgccgggatcttcctgttcttcatgcagggcaaggggatcggcaagctgagcatgggcctcatcaccatcgccgtggcctccgggctgctgtgggtggccgagatccagccccagtggatcgcggccagcatcatcctcgagttcttcctgatggtcctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtgaagacggagaccaccatcctcgacgtcgacctgcgccccgcctccgcgtggaccctgtacgccgtggccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtccccctgctcgccatgggctgctacagccaggtgaaccccaccaccctgaccgcgtccctggtgatgctcctggtccactacgccatcatcgggccgggcctgcaggccaaggccacgcgggaggcgcagaagcgcaccgccgccggcatcatgaagaaccccaccgtggacgggatcaccgtgatcgacctcgagcccatcagctacgaccccaagttcgagaagcagctgggccaggtcatgctgctcgtgctgtgcgccgggcagctgctcctgatgcggacgacctgggccttctgcgaggtgctgaccctcgcgaccggcccgacgctgaccctgtgggaggggaaccccggccgcttctggaacaccaccatcgccgtctccacggccaacatcttccggggcagctacctcgccggggccggcctggcgttctccctgatcaagaacgcccagaccccccgccgggggaccggcaccgccggggagaccctcggcgagaagtggaagcgccagctgaacagcctggaccggaaggagttcgaggagtacaagcgctccggcatcctcgaggtggaccggacggaggccaagagcgccctgaaggacgggtccaagatcaagcacgcggtgagccgcggctccagcaagatccggtggatcgtcgagcgcgggatggtgaagcccaagggcaaggtggtcgacctggggtgcggccgcggcgggtggtcctactacatggccaccctcaagaacgtgaccgaggtgaagggctacaccaaggggggcccggggcacgaggagcccatccccatggccacgtacggctggaacctggtcaagctgcacagcggcgtggacgtgttctacaagcccaccgagcaggtcgacaccctcctgtgcgacatcggggagagctccagcaacccgaccatcgaggagggccggacgctgcgcgtgctcaagatggtggagccctggctgtccagcaagcccgagttctgcatcaaggtcctgaacccctacatgccgaccgtgatcgaggagctggagaagctccagcggaagcacgggggcaacctggtgcgctgccccctgtcccggaacagcacccacgagatgtactgggtctccggcgccagcgggaacatcgtgtccagcgtcaacaccacgtccaagatgctcctgaaccgcttcaccacccggcaccgcaagcccacctacgagaaggacgtggacctgggcgcggggacgcggagcgtgtccaccgagaccgagaagcccgacatgaccatcatcggccgccggctccagcgcctgcaggaggagcacaaggagacgtggcactacgaccaggagaacccgtaccggacctgggcctaccacgggagctacgaggccccctccaccggcagcgcctccagcatggtcaacggcgtggtgaagctgctcaccaagccctgggacgtcatcccgatggtgacgcagctggccatgaccgacaccacccccttcgggcagcagcgcgtgttcaaggagaaggtcgacacgcggaccccccagcccaagccgggcacccgcatggtgatgaccacgaccgcgaactggctgtgggccctcctggggaagaagaagaacccccggctgtgcacccgcgaggagttcatctccaaggtgcggagcaacgccgccatcggcgccgtcttccaggaggagcaggggtggaccagcgcgaacgaggccgtgaacgactcccgcttctgggagctcgtggacaaggagcgggccctgcaccaggagggcaagtgcgagagctgcgtctacaacatgatgggcaagcgcgagaagaagctgggggagttcggccgcgccaaggggtcccgggccatctggtacatgtggctcggcgcgcgcttcctggagttcgaggccctggggttcctcaacgaggaccactggttcggccgggagaacagctggtccggcgtggagggggagggcctgcaccgcctggggtacatcctcgaggagatcgacaagaaggacggcgacctgatgtacgccgacgacacggccggctgggacacccggatcaccgaggacgacctgcagaacgaggagctcatcaccgagcagatggcgccccaccacaagatcctggccaaggccatcttcaagctgacctaccagaacaaggtggtcaaggtgctccgccccacgccgcggggggccgtgatggacatcatcagccgcaaggaccagcggggctccgggcaggtcggcacctacgggctgaacaccttcaccaacatggaggtgcagctgatccgccagatggaggccgagggcgtgatcacgcaggacgacatgcagaaccccaagggcctcaaggagcgggtcgagaagtggctgcgcgagtgcggggtggaccggctgaagcgcatggcgatcagcggcgacgactgcgtggtcaagcccctcgacgagcggttcgggacctccctgctgttcctcaacgacatgggcaaggtgcgcaaggacatcccccagtgggagccgagcaaggggtggaagaactggcaggaggtgcccttctgctcccaccacttccacaagatcttcatgaaggacggccggagcctggtcgtgccctgccgcaaccaggacgagctgatcggccgggcccgcatctcccagggggccggctggagcctccgcgagaccgcctgcctggggaaggcctacgcgcagatgtggtccctgatgtacttccaccggcgcgacctccggctggccagcatggccatctgctccgccgtgcccaccgagtggttcccgacgagccgcaccacctggagcatccacgcccaccaccagtggatgaccacggaggacatgctgaaggtctggaaccgggtgtggatcgaggacaaccccaacatgatcgacaagacccccgtgcactcctgggaggacatcccctacctcggcaagcgcgaggacctgtggtgcgggagcctgatcggcctctccagccgggcgacctgggccaagaacatccacaccgccatcacgcaggtccgcaacctgatcggcaaggaggagtacgtggactacatgccggtgatgaagcggtactccgcccccagcgagtccgagggggtcctgtga

SEQ ID NO: 10422 - RNA, 9867 nt, synthetic construct
  misc_feature 1..9867: note = derived and/or modified CDS sequence (opt1) from DENV-4__JN983813__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacatcagcgcgatcacccaggccgagcggatcggggagcccgactacgaggtcgacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtggtcgccgccgagatggaggaggccctgcgcgggctccccatccggtaccagacccccgccgtgaagagcgagcacacgggccgcgagatcgtggacctgatgtgccacgcgaccttcaccacccggctgctctccagcacgcgcgtcccgaactacaacctgatcgtgatggacgaggcccacttcaccgaccccagctccgtggccgcccgggggtacatcagcacccgcgtcgagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtcccgagcatcaaggccgggaacgacatcgcgaactgcctgcgcaagtccggcaagaaggtgatccagctcagccggaagaccttcgacaccgagtaccccaagaccaagctgacggactgggacttcgtggtcaccaccgacatctccgagatgggggccaacttccgcgccggccgggtgatcgacccccgccggtgcctgaagcccgtgatcctcaccgacgggccggagcgcgtcatcctggccggccccatccccgtgacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtcgagctgatgcggcgcggcgacctgcccgtgtggctcagctacaaggtggcctccgccgggatcagctacaaggaccgggagtggtgcttcaccggcgagcgcaacaaccagatcctggaggagaacatggaggtcgagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtcgccctgctcggcgcgatgaccgccgggatcttcctgttcttcatgcagggcaaggggatcggcaagctgagcatgggcctcatcaccatcgccgtggcctccgggctgctgtgggtggccgagatccagccccagtggatcgcggccagcatcatcctcgagttcttcctgatggtcctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtgaagacggagaccaccatcctcgacgtcgacctgcgccccgcctccgcgtggaccctgtacgccgtggccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtccccctgctcgccatgggctgctacagccaggtgaaccccaccaccctgaccgcgtccctggtgatgctcctggtccactacgccatcatcgggccgggcctgcaggccaaggccacgcgggaggcgcagaagcgcaccgccgccggcatcatgaagaaccccaccgtggacgggatcaccgtgatcgacctcgagcccatcagctacgaccccaagttcgagaagcagctgggccaggtcatgctgctcgtgctgtgcgccgggcagctgctcctgatgcggacgacctgggccttctgcgaggtgctgaccctcgcgaccggcccgatcctgacgctgtgggaggggaaccccggccgcttctggaacaccaccatcgccgtctccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtgagccgcggctccagcaagatccggtggatcgtcgagcgcgggatggtgaagcccaagggcaaggtggtcgacctggggtgcggccgcggcgggtggtcctactacatggccacgctcaagaacgtgaccgaggtgaagggctacaccaaggggggcccggggcacgaggagcccatccccatggccacctacggctggaacctggtcaagctgcacagcggcgtggacgtgttctacaagcccacggagcaggtcgacaccctcctgtgcgacatcggggagagctccagcaacccgaccatcgaggagggccggaccctgcgcgtgctcaagatggtggagccctggctgtccagcaagcccgagttctgcatcaaggtcctgaacccctacatgccgacggtgatcgaggagctggagaagctccagcggaagcacgggggcaacctggtgcgctgccccctgtcccggaacagcacccacgagatgtactgggtctccggcgccagcgggaacatcgtgtccagcgtcaacaccacctccaagatgctcctgaaccgcttcacgacccggcaccgcaagcccacctacgagaaggacgtggacctgggcgcggggacccggagcgtgtccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtcaacggcgtggtgaagctgctcaccaagccctgggacgtcatcccgatggtgacccagctggccatgacggacaccacccccttcgggcagcagcgcgtgttcaaggagaaggtcgacacccggacgccccagcccaagccgggcacccgcatggtgatgaccaccacggcgaactggctgtgggccctcctggggaagaagaagaacccccggctgtgcacccgcgaggagttcatctccaaggtgcggagcaacgccgccatcggcgccgtcttccaggaggagcaggggtggaccagcgcgtccgaggccgtgaacgacagccgcttctgggagctcgtggacaaggagcgggccctgcaccaggagggcaagtgcgagtcctgcgtctacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtggtcaaggtgctccgccccaccccgcggggggccgtgatggacatcatctcccgcaaggaccagcggggcagcgggcaggtcggcacgtacgggctgaacaccttcaccaacatggaggtgcagctgatccgccagatggaggccgagggcgtgatcacccaggacgacatgcagaaccccaagggcctcaaggagcgggtcgagaagtggctgcgcgagtgcggggtggaccggctgaagcgcatggcgatctccggcgacgactgcgtggtcaagcccctcgacgagcggttcgggacgagcctgctgttcctcaacgacatgggcaaggtgcgcaaggacatcccccagtgggagccgtccaaggggtggaagaactggcaggaggtgcccttctgcagccaccacttccacaagatcttcatgaaggacggccggtccctggtcgtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtgcccaccgagtggttcccgaccagccgcacgacctggtccatccacgcccaccaccagtggatgaccaccgaggacatgctgaaggtctggaaccgggtgtggatcgaggacaaccccaacatgatcgacaagacgcccgtgcacagctgggaggacatcccctacctcggcaagcgcgaggacctgtggtgcgggtccctgatcggcctcagctcccgggcgacctgggccaagaacatccacaccgccatcacccaggtccgcaacctgatcggcaaggaggagtacgtggactacatgccggtgatgaagcggtacagcgccccctccgagagcgagggggtcctgtga

SEQ ID NO: 10423 - RNA, 9867 nt, synthetic construct
  misc_feature 1..9867: note = derived and/or modified CDS sequence (opt1) from DENV-4__KF041260__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcgcctgggtcatgtacggcacctgcacccagtccggggagcggcgccgggagaagcgcagcgtggccctgaccccgcactccggcatgggcctcgagacgcgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtcttcttcatcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgacgaccatggcccagggcaagcccaccctggacttcgagctcatcaagaccacggccaaggaggtcgccctgctgcggacctactgcatcgaggcgtccatcagcaacatcaccaccgccacgcgctgcccgacccagggggagccctacctcaaggaggagcaggaccagcagtacatctgccggcgcgacgtggtggaccggggctgggggaacggctgcggcctgttcgggaagggcggggtcgtgacctgcgccaagttctcctgcagcggcaagatcaccgggaacctgatccagatcgagaacctcgagtacacggtggtcgtgaccgtgcacaacggcgacacccacgccgtcggcaacgacacctccaaccacggggtgacggccaccgtcaccccccgcagcccctccgtggaggtggagctgccggactacggcgagctgaccctcgactgcgagccccggagcgggatcgacttcaacgagatgatcctgatgaagatgaacaagaagacgtggctggtccacaagcagtggttcctcgacctgcccctgccctggaccgcgggcgccgacacctccgaggtgcactggaaccacaaggagcgcatggtgaccttcaaggtcccgcacgccaagcggcaggacgtgaccgtgctcgggagccaggagggcgccatgcacagcgccctgacgggcgcgaccgaggtcgactccggggacggcaaccacatgttcgccgggcacctgaagtgcaaggtgcgcatggagaagctccgcatcaagggcatgagctacaccatgtgctccggcaagttcagcatcgacaaggagatggccgagacccagcacgggacgaccgtggtcaaggtgaagtacgagggcgccggggccccctgcaaggtgcccatcgagatccgggacgtcaacaaggagaaggtggtgggccgcatcatctccagcacccccttcgcggagaacaccaactccgtcacgaacatcgagctggagccgcccttcggggacagctacatcgtgatcggcgtgggcgactccgccctgaccctccactggttccggaaggggagctccatcggcaagatgttcgagagcacctaccgcggggccaagcggatggccatcctgggcgagaccgcgtgggacttcgggtccgtcggcggcctgctcacgagcctggggaaggccgtgcaccaggtgttcggctccgtctacaccaccatgttcgggggcgtgagctggatggtgcgcatcctgatcgggttcctcgtcctgtggatcggcaccaactcccggaacacgagcatggccatgtcctgcatcgccgtgggcgggatcaccctgttcctgggcttcaccgtgcacgccgacatggggtgcgcggtcagctggagcggcaaggagctcaagtgcgggtccggcatcttcatcatcgacaacgtgcacacctggacggagcagtacaagttccagcccgagagccccgcccgcctggcctccgccatcctgaacgcccacaaggacggcgtgtgcgggatccggagcaccacccgcctcgagaacgtcatgtggaagcagatcaccaacgagctgaactacgtgctgtgggagggcgggcacgacctcacggtggtcgcgggcgacgtgaagggcgtgctgtccaaggggaagcgggccctggccccgcccgtcaacgacctcaagtacagctggaagacctggggcaaggccaagatcttcacccccgagacccgcaactccacgttcctgatcgacgggcccgacaccagcgagtgcccgaacgagcggcgcgcctggaacttcctggaggtggaggactacggcttcgggatgttcaccaccaacatctggatgaagttccgggagggctccagcgaggtgtgcgaccaccgcctcatgtccgcggccatcaaggaccagaaggccgtccacgccgacatgggctactggatcgagagctccaagaaccagacgtggcagatcgagaaggcgagcctgatcgaggtgaagacctgcctgtggcccaagacccacaccctctggtccaacggggtgctggagagccagatgctgatccccaaggcctacgccggcccgttctcccagcacaactaccggcaggggtacgccacgcagaccatgggcccctggcacctcgggaagctggagatcgacttcggcgagtgccccggcaccaccgtcaccatccaggaggactgcgaccaccgcgggcccagcctgcggacgaccaccgccagcggcaagctcgtgacccagtggtgctgccgctcctgcacgatgccgcccctgcgcttcctgggggaggacggctgctggtacgggatggagatccggcccctcagcgagaaggaggagaacatggtgaagtcccaggtcagcgcgggccagggcacctccgagaccttcagcatggggctgctgtgcctcaccctgttcgtggaggagtgcctgcgccggcgcgtgacgcggaagcacatgatcctcgtcgtggtcaccaccctgtgcgccatcatcctgggcgggctcacctggatggacctgctgcgcgccctcatcatgctgggcaacacgatgtccagccggatgggcgggcagacccacctggccatcatggccgtgttcaagatgtcccccggctacgtgctcgggatcttcctgcgcaagctgaccagccgggagaccgcgctcatggtcatcggcatggccatgacgaccgtgctgtccatcccgcacgacctgatggagttcatcgacgggatcagcctcggcctgatcctgctcaagatggtgacccacttcgacaacacccaggtcggcacgctggccctgtccctcaccttcatcaagagcaccatgcccctggtgatggcctggcgcaccatcatggccgtgctgttcgtcgtgacgctcatccccctgtgccggacctcctgcctgcagaagcagagccactgggtggagatcaccgcgctcatcctgggggcccaggccctgcccgtctacctcatgaccctgatgaagggcgcctccaagcgcagctggccgctgaacgaggggatcatggcggtgggcctcgtgtccctgctggggagcgccctcctgaagaacgacgtccccctggccggccccatggtggccggcgggctcctgctggccgcgtacgtgatgagcggctccagcgccgacctctccctggagaaggccgccacggtccagtgggacgagatggccgacatcaccgggagctcccccatcatcgaggtgaagcaggacgaggacggcagcttctccatccgggacgtggaggagaccaacatgatcaccctgctcgtcaagctggcgctgatcacggtgagcgggctctacccgctggccatccccgtgaccatgaccctgtggtacatgtggcaggtcaagacccagcgctccggcgccctctgggacgtgcccagccccgccgccacgcagaaggcgaccctgaccgagggcgtgtaccggatcatgcagcgcgggctgttcggcaagacccaggtcggggtgggcatccacatggagggggtgttccacaccatgtggcacgtcacgcggggctccgtgatctgccacgagagcggccgcctcgagccgtcctgggccgacgtgaagaacgacatgatcagctacgggggcgggtggcggctgggcgacaagtgggacaaggaggaggacgtccaggtgctggccgtggagcccggcaagaaccccaagcacgtccagaccaagcccgggctcttcaagaccctgaccggcgagatcggggccgtgacgctggacttcaagccgggcacctccgggagccccatcatcaaccgcaagggcaaggtgatcggcctctacgggaacggcgtcgtgaccaagtccggggactacgtgagcgccatcacccaggcggagcggatcggcgagcccgactacgaggtcgacgaggacatcttccgcaagaagcgcctgacgatcatggacctgcacccgggggccggcaagaccaagcggatcctcccctccatcgtgcgcgaggccctgaagcggcgcctgcggaccctgatcctcgcccccacccgcgtggtcgcggccgagatggaggaggccctgcggggcctgcccatccgctaccagacgccggccgtgaagaccgagcacaccgggcgggagatcgtggacctcatgtgccacgccaccttcacgacccgcctgctgagcagcacccgggtccccaactacaacctcatcgtgatggacgaggcgcacttcaccgacccctccagcgtggccgcccgcggctacatctccacgcgggtcgagatgggggaggccgccgcgatcttcatgaccgccacccccccgggcaccacggaccccttcccccagagcaactcccccatcgaggacatcgagcgcgagatcccggagcggagctggaacaccgggttcgactggatcaccgactaccagggcaagaccgtgtggttcgtcccctccatcaaggccggcaacgacatcgccaactgcctgcgcaagagcgggaagaaggtggtgcagctgtcccggaagacgttcgacaccgagtaccccaagaccaagctcaccgactgggacttcgtcgtgacgaccgacatcagcgagatgggcgccaacttccgcgcggggcgggtgatcgacccccgccgctgcctgaagccggtcatcatcaccgacggccccgagcgggtgatcctggccgggcccatccccgtgaccccggcctccgccgcgcagcgccggggccgcatcggccggaaccccgcccaggaggacgaccagtacgtcttcagcggggaccccctccgcaacgacgaggaccacgcccactggacggaggccaagatgctgctggacaacatccacacccccgagggcatcatcccgaccctcttcgggcccgagcgggagaagacccaggccatcgacggcgagttccgcctgcggggcgagcagcgcaagacgttcgtggagctgatgcggcgcggggacctccccgtgtggctgtcctacaaggtcgcgagcgccggcatctcctacaaggaccgggagtggtgcttcaccggggagcgcaacaaccagatcctggaggagaacatggaggtggagatctggacccgggagggcgagaagaagaagctccgccccaagtggctggacgcccgggtgtacgccgacccggtcgccctgaaggacttcaaggagttcgcgagcgggcgcaagtccatcaccctcgacatcctgaccgagatcgccagcctgcccacgtacctctccagccgggccaagctggccctggacaacatcgtgatgctccacaccaccgagcgcggcggcaaggcctaccagcacgcgctgaacgagctgcccgagagcctcgagaccctgatgctggtggccctcctgggggccatgacggccggcatcttcctgttcttcatgcaggggaagggcatggggaagctctccatgggcctgatcgcgatcgccgtcgccagcggcctgctctgggtggccgagatccagccgcagtggatcgccgcgtccatcatcctggagttcttcctgatggccctcctgatccccgagcccgagaagcagcggaccccccaggacaaccagctgatctacgtgatcctcaccatcctgaccatcatcgggctggtcgccgccaacgagatgggcctcatcgagaagacgaagaccgacttcgggttctaccaggtgaagaccgagaccacgatcctggacgtggacctgcgcccggccagcgcgtggaccctctacgccgtcgccaccaccatcctgacgcccatgctgcgccacaccatcgagaacacctccgccaacctcagcctggccgcgatcgccaaccaggccgccgtgctgatgggcctcgggaagggctggcccctgcaccggatggacctgggcgtgcccctcctggccatggggtgctactcccaggtcaacccgaccacgctgaccgcgagcctcgtgatgctgctggtgcactacgccatcatcggccccgggctccaggccaaggccacccgcgaggcgcagaagcggaccgccgccggcatcatgaagaaccccacggtcgacggcatcaccgtgatcgacctggagcccatctcctacgacccgaagttcgagaagcagctggggcaggtgatgctcctggtcctgtgcgccggccagctcctgctgatgcgcaccacctgggccttctgcgaggtgctcacgctggcgaccgggcccatcctgaccctctgggagggcaaccccgggcggttctggaacaccacgatcgccgtgagcaccgccaacatcttccgcggctcctacctggccggcgccgggctggcgttcagcctcatcaagaacacccagaccccccggcgcggcacggggaccaccggcgagaccctgggggagaagtggaagcggcagctgaactccctcgaccgcaaggagttcgaggagtacaagcggagcggcatcctggaggtcgaccgcaccgaggccaagtccgccctgaaggacggcagcaagatcaagtacgccgtgtcccgggggacgagcaagatccgctggatcgtggagcggggcatggtcaagccgaaggggaaggtggtggacctcggctgcgggcgcggcggctggtcctactacatggccaccctgaagaacgtcaccgaggtgaaggggtacaccaagggcgggcccggccacgaggagcccatccccatggcgacgtacgggtggaacctggtgaagctccacagcggcgtcgacgtgttctacaagccgaccgagcaggtggacaccctgctgtgcgacatcggcgagagctccagcaaccccaccatcgaggaggggcggacgctccgcgtcctgaagatggtggagccctggctgtccagcaagcccgagttctgcatcaaggtgctcaacccgtacatgcccaccgtcatcgaggagctggagaagctgcagcggaagcacggcgggtccctggtgcgctgccccctcagccgcaactccacccacgagatgtactgggtcagcggcgtgtccggcaacatcgtgagctccgtcaacaccacgagcaagatgctgctgaaccggttcaccacccgctaccggaagcccacctacgagaaggacgccgacctcggggccggcacgcgctccgtgagcaccgagaccgagaagccggacatggccatcatcgggcggcgcctgcagcggctgcaggaggagcacaaggagacctggcactacgaccaggagaacccctaccgcacgtgggcgtaccacggctcctacgaggcccccagcaccgggtccgccagctccatggtgaacggcgtcgtgaagctcctgaccaagccgtgggacgtgatccccatggtcacccagctggccatgacggacaccacccccttcggccagcagcgggtgttcaaggagaaggtggacacccgcacgccccagccgaagcccgggacccggatgatcatgaccaccacggccaactggctctgggcgctgctgggcaagaagaagaacccccgcctctgcacccgggaggagttcatcagcaaggtccgcagcaacgccgccatcggggccgtgttccaggaggagcagggctggacctccgccagcgaggcggtgaacgactcccggttctgggagctggtcgacaaggagcgcgccctgcaccaggaggggaagtgcgagagctgcgtgtacaacatgatgggcaagcgggagaagaagctcggcgagttcgggcgcgccaagggctcccgggccatctggtacatgtggctgggggcccgcttcctggagttcgaggcgctcggcttcctgaacgaggaccactggttcgggcgggagaacagctggtccggcgtggagggcgaggggctgcaccgcctcggctacatcctggaggacatcgacaagaaggacggggacctgatctacgccgacgacaccgccggctgggacacgcgcatcaccgaggacgacctcctgaacgaggagctgatcaccgagcagatggccccccaccacaagatcctcgcgaaggccatcttcaagctgacctaccagaacaaggtcgtgaaggtgctgcggccgacccccaagggcgccgtcatggacatcatcagccgcaaggaccagcgggggtccggccaggtggggacgtacggcctcaacaccttcaccaacatggaggtgcagctgatccgccagatggaggccgagggggtcatcacccgggacgacatgcacaaccccaagggcctgaaggagcgcgtggagaagtggctcaaggagtgcggcgtggaccggctgaagcgcatggccatcagcggggacgactgcgtcgtgaagcccctggacgagcggttctccacgagcctcctgttcctgaacgacatgggcaaggtgcgcaaggacatcccgcagtgggagccctccaaggggtggaagaactggcaggaggtccccttctgcagccaccacttccacaagatcttcatgaaggacggccggtccctcgtggtgccctgccgcaaccaggacgagctgatcgggcgggcgcgcatcagccagggcgccggctggtccctgcgggagaccgcctgcctcgggaaggcctacgcccagatgtggagcctgatgtacttccaccgccgggacctgcgcctcgcgagcatggccatctgctccgccgtcccgaccgagtggttccccaccagccggacgacctggtccatccacgcccaccaccagtggatgaccaccgaggacatgctgaaggtgtggaaccgcgtgtggatcgaggacaaccccaacatgacggacaagacccccgtccacagctgggaggacatcccgtacctgggcaagcgcgaggacctctggtgcgggtccctgatcggcctgagctcccgggccacctgggcgaagaacatccacaccgccatcacgcaggtgcgcaacctcatcgggaaggaggagtacgtggactacatgcccgtcatgaagcggtacagcgcccccttcgagtccgagggcgtgctgtga

SEQ ID NO: 10424 - RNA, 9867 nt, synthetic construct
  misc_feature 1..9867: note = derived and/or modified CDS sequence (opt1) from DENV-4__FJ024476__SS-prME
  source 1..9867: mol_type = other RNA
agcaccatcaccctgctctgcctgatccccaccgtgatggccttccacctgtccacccgggacggcgagccgctcatgatcgtggccaagcacgagcgggggcggcccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccgccacctgggtgatgtacgggacctgcacccagagcggggagcggcgccgggagaagcgctccgtggccctgaccccgcacagcggcatgggcctcgagacccgggccgagacctggatgtccagcgagggggcctggaagcacgcgcagcgcgtggagtcctggatcctgcggaaccccggcttcgccctgctcgccgggttcatggcctacatgatcggccagaccgggatccagcgcacggtgttcttcgtgctgatgatgctggtggcgcccagctacggcatgcggtgcgtgggcgtggggaaccgcgacttcgtggagggcgtctccgggggcgcctgggtggacctcgtgctggagcacggcgggtgcgtcaccaccatggcccagggcaagcccaccctggacttcgagctcacgaagaccaccgccaaggaggtggccctgctgcggacctactgcatcgaggcgagcatctccaacatcacgaccgccacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctggtccagatcgagaacctcgagtacaccgtggtggtcaccgtgcacaacggcgacacgcacgccgtcggcaacgacaccagcaaccacggggtgaccgccatgatcacgccccggtcccccagcgtggaggtcaagctgccggactacggcgagctgacgctcgactgcgagccccggtccgggatcgacttcaacgagatgatcctgatgaagatgaagaagaagacctggctggtgcacaagcagtggttcctcgacctgcccctgccctggaccgcgggcgccgacaccagcgaggtgcactggaactacaaggagcgcatggtcaccttcaaggtgccgcacgccaagcggcaggacgtgacggtcctcgggtcccaggagggcgccatgcacagcgccctggcgggcgccaccgaggtggacagcggggacggcaaccacatgttcgccgggcacctgaagtgcaaggtgcgcatggagaagctccgcatcaagggcatgtcctacaccatgtgcagcggcaagttctccatcgacaaggagatggccgagacccagcacgggacgaccgtcgtgaaggtgaagtacgagggcgccggggcgccctgcaaggtccccatcgagatccgggacgtgaacaaggagaaggtggtcggccgcatcatcagctccacgcccctggccgagaacaccaacagcgtgacgaacatcgagctggagccgcccttcggggactcctacatcgtgatcggcgtcggcaacagcgccctcaccctgcactggttccggaaggggtccagcatcggcaagatgttcgagtccacctaccgcggggccaagcggatggcgatcctgggcgagaccgcctgggacttcgggagcgtgggcggcctcttcacgtccctggggaaggccgtgcaccaggtcttcggcagcgtgtacaccaccatgttcgggggcgtgtcctggatgatccgcatcctgatcgggctcctggtcctgtggatcggcaccaacagccggaacacgtccatggccatgacctgcatcgccgtgggcgggatcaccctgttcctcggcttcaccgtgcaggcggacatggggtgcgtcgtgagctggtccggcaaggagctgaagtgcgggagcggcatcttcgtggtcgacaacgtgcacacgtggaccgagcagtacaagttccagcccgagagccccgcccgcctggcctccgccatcctcaacgcccacaaggacggcgtgtgcgggatccggagcaccacccgcctggagaacgtcatgtggaagcagatcacgaacgagctgaactacgtgctctgggagggcgggcacgacctgaccgtggtcgcgggcgacgtgaagggcgtgctgaccaaggggaagcgggccctcaccccgcccgtctccgacctgaagtacagctggaagacgtggggcaaggcccgcatcttcacccccgaggcccggaactccaccttcctgatcgacgggcccgacaccagcgagtgcccgaacgagcgccgggcctggaactccctcgaggtggaggactacggcttcgggatgttcacgaccaacatctggatgaagttccgcgagggcagctccgaggtgtgcgaccaccggctgatgagcgcggccatcaaggaccagaaggccgtccacgccgacatgggctactggatcgagtccagcaagaaccagacctggcagatcgagcgcgcgtccctgatcgaggtgaagacctgcctctggcccaagacgcacaccctgtggagcaacggggtgctggagtcccagatgctcatccccaagagctacgccggcccgttctcccagcacaactaccggcaggggtacgccacccagaccatgggcccctggcacctggggaagctggagatcggcttcggcgagtgccccgggaccacggtcaccatccaggaggactgcgaccaccgcggccccagcctccgcaccaccacggccagcgggaagctggtgacccagtggtgctgccggtcctgcaccatgccgcccctgcgcttcctcggcgaggacgggtgctggtacggcatggagatccggcccctgagcgagcgcgaggagaacatggtgaagtcccaggtcaccgccggccaggggacgagcgagaccttctccatgggcctgctctgcctgaccctgttcgtggaggagtgcctccggcgccgggtcacccgcaagcacatgatcctggtggtggtcatcacgctgtgcgcgatcatcctcgggggcctgacctggatggacctgctccgggccctgatcatgctgggcgacaccatgagcgggcgcatcggcgggcagatccacctcgccatcatggccgtgttcaagatgtcccccggctacgtgctgggggtcttcctgcggaagctcaccagccgcgagacggccctgatggtgatcggcatggcgatgaccaccgtgctgtccatcccgcacgacctcatggagctgatcgacggcatcagcctggggctcatcctgctgaagatcgtcacccagttcgacaacacccaggtgggcaccctcgccctgtccctgaccttcatccggagcaccatgcccctcgtgatggcctggcgcacgatcatggccgtcctgttcgtggtgaccctgatccccctctgccggacctcctgcctgcagaagcagagccactgggtcgagatcaccgccctgatcctcggggcgcaggccctgcccgtgtacctgatgacgctcatgaagggcgcctcccgccggagctggccgctgaacgaggggatcatggccgtgggcctggtctccctcctgggcagcgcgctgctcaagaacgacgtgcccctggccgggcccatggtggccggcgggctgctcctggccgcctacgtcatgtccggcagcagcgcggacctgtccctcgagaaggccgccaacgtgcagtgggacgagatggccgacatcaccgggagctcccccatcatcgaggtgaagcaggacgaggacggcagcttctccatccgcgacgtcgaggagaccaacatgatcaccctgctggtgaagctcgccctgatcacggtgagcggcctgtacccgctcgcgatccccgtcaccatgaccctgtggtacatgtggcaggtcaagacccagcggtccggggccctgtgggacgtgcccagccccgccgccacgcagaaggccgcgctctccgagggcgtctaccgcatcatgcagcgggggctgttcggcaagacccaggtgggggtgggcatccacatggagggcgtcttccacaccatgtggcacgtgacccgcgggagcgtgatctgccacgagaccggccgcctggagccgtcctgggccgacgtccggaacgacatgatcagctacgggggcggctggcgcctcggggacaagtgggacaaggaggaggacgtccaggtgctggccatcgagcccggcaagaaccccaagcacgtccagacgaagcccgggctgttcaagaccctcaccggcgagatcggggccgtgaccctggacttcaagccgggcacgtccggcagccccatcatcaaccggaaggggaaggtgatcggcctgtacgggaacggcgtcgtgaccaagtccggggactacgtgagcgccatcacccaggcggagcgcatcggcgagcccgactacgaggtcgacgaggacatcttccggaagaagcgcctcaccatcatggacctgcacccgggcgccgggaagacgaagcggatcctgccctccatcgtgcgcgaggccctgaagcggcgcctccggaccctgatcctggcccccacccgcgtggtcgcggccgagatggaggaggccctccggggcctgcccatccgctaccagaccccggccgtcaagagcgagcacacggggcgggagatcgtggacctgatgtgccacgccaccttcaccacccgcctcctgtccagcacgcgggtccccaactacaacctgatcgtgatggacgaggcgcacttcaccgaccccagctccgtcgccgcccgcggctacatcagcacccgggtggagatgggggaggccgccgcgatcttcatgaccgccacgcccccgggcgccaccgaccccttcccccagtccaacagccccatcgaggacatcgagcgcgagatcccggagcgctcctggaacaccggcttcgactggatcaccgactaccaggggaagacggtgtggttcgtccccagcatcaaggccggcaacgacatcgccaactgcctccggaagtccgggaagaaggtggtgcagctgagccgcaagaccttcgacaccgagtaccccaagaccaagctgacggactgggacttcgtcgtgaccaccgacatctccgagatgggcgcgaacttccgggccgggcgcgtgatcgacccccggcgctgcctcaagccggtcatcctgaccgacggccccgagcgggtgatcctggccggccccatccccgtgacgccggccagcgcggcccagcgccgggggcgcatcggccggaaccccgcccaggaggacgaccagtacgtcttctccggggaccccctcaagaacgacgaggaccacgcccactggaccgaggccaagatgctgctggacaacatctacacccccgagggcatcatcccgaccctcttcggccccgagcgcgagaagacgcaggcgatcgacggggagttccggctgcgcggcgagcagcggaagaccttcgtggagctgatgcgccgcggcgacctccccgtgtggctgagctacaaggtcgcctccgccggcatcagctacaaggaccgcgagtggtgcttcaccggggagcggaacaaccagatcctggaggagaacatggaggtggagatctggacccgcgagggcgagaagaagaagctccggccccgctggctggacgcccgcgtgtacgccgacccgatggcgctgaaggacttcaaggagttcgcctccggccgcaagagcatcacgctcgacatcctgaccgagatcgcctccctgcccacctacctcagctcccgcgccaagctggccctggacaacatcgtcatgctccacaccaccgagcgcggcgggcgcgcgtaccagcacgccctgaacgagctgcccgagagcctcgagacgctgatgctggtggccctcctgggggccatgaccgcggggatcttcctgttcttcatgcaggggaagggcatcggcaagctcagcatggggctgatcaccatcgccgtggcctccggcctgctctgggtcgccgagatccagccgcagtggatcgccgcgagcatcatcctggagttcttcctgatggtgctcctgatccccgagcccgagaagcagcggacgccccaggacaaccagctgatctacgtgatcctcacgatcctgaccatcatcgggctgatcgccgccaacgagatgggcctcatcgagaagaccaagaccgacttcgggttctaccaggtcaagacggagaccaccatcctggacgtggacctgcgcccggcctccgcctggaccctctacgcggtggccacgaccatcctgacccccatgctgcggcacaccatcgagaacacgagcgccaacctctccctggccgccatcgcgaaccaggccgccgtcctgatgggcctcggcaaggggtggcccctgcaccgcatggacctgggcgtgcccctcctggccatggggtgctacagccaggtgaacccgaccaccctgaccgcctccctcgtcatgctgctggtgcactacgcgatcatcggccccggcctccaggccaaggccacgcgggaggcccagaagcgcaccgcggccgggatcatgaagaaccccaccgtggacggcatcaccgtcatcgacctggagcccatcagctacgacccgaagttcgagaagcagctgggccaggtgatgctcctggtgctgtgcgccggccagctcctgctgatgcggacgacctgggccttctgcgaggtcctcaccctggccaccgggcccatcctgacgctctgggagggcaaccccggccgcttctggaacaccaccatcgcggtgtccaccgccaacatcttccgggggagctacctggccggcgccgggctggccttctccctcatcaagaacgcgcagacgccccgccggggcaccgggaccaccggcgagacgctgggcgagaagtggaagcgccagctgaacagcctcgaccggaaggagttcgaggagtacaagcgctccgggatcctggaggtggaccggaccgaggccaagagcgccctgaaggacggctccaagatcaagcacgccgtcagccgcgggtccagcaagatccgctggatcgtggagcggggcatggtgaagccgaaggggaaggtcgtggacctcggctgcggccgcgggggctggtcctactacatggccaccctgaagaacgtgaccgaggtcaaggggtacaccaagggcgggcccggccacgaggagcccatccccatggcgacgtacggctggaacctggtgaagctccacagcggggtggacgtcttctacaagccgaccgagcaggtcgacaccctgctgtgcgacatcggcgagagctccagcaaccccaccatcgaggaggggcggacgctccgcgtgctgaagatggtcgagccctggctgtccagcaagcccgagttctgcatcaaggtgctgaacccgtacatgcccaccgtcatcgaggagctcgagaagctgcagcggaagcacggcggcaacctggtgcgctgccccctctcccggaacagcacccacgagatgtactgggtgtccggggccagcggcaacatcgtctccagcgtgaacaccacgtccaagatgctgctgaaccgcttcaccacccggcaccgcaagcccacctacgagaaggacgtggacctcggggccggcacgcggagcgtctccaccgagaccgagaagccggacatgaccatcatcgggcgccggctgcagcgcctgcaggaggagcacaaggagacgtggcactacgaccaggagaacccctaccggacctgggcctaccacggcagctacgaggcgccctccaccggcagcgcctccagcatggtgaacggggtggtcaagctcctgaccaagccgtgggacgtgatccccatggtgacgcagctggccatgaccgacaccacccccttcggccagcagcgcgtcttcaaggagaaggtggacacgcggacgccccagccgaagcccgggacccgcatggtgatgaccacgaccgccaactggctctgggccctgctgggcaagaagaagaacccccggctctgcacccgcgaggagttcatctccaaggtccggagcaacgcggccatcggggccgtgttccaggaggagcagggctggaccagcgcctccgaggccgtgaacgacagccgcttctgggagctggtcgacaaggagcgcgcgctgcaccaggagggcaagtgcgagtcctgcgtgtacaacatgatggggaagcgggagaagaagctcggcgagttcgggcgcgccaagggcagccgggccatctggtacatgtggctgggggcccgcttcctggagttcgaggccctcggcttcctgaacgaggaccactggttcggccgggagaactcctggagcggggtggagggcgaggggctgcaccgcctcggctacatcctggaggagatcgacaagaaggacggcgacctgatgtacgcggacgacacggccgggtgggacacccggatcaccgaggacgacctccagaacgaggagctgatcaccgagcagatggcgccccaccacaagatcctggccaaggcgatcttcaagctcacgtaccagaacaaggtcgtgaaggtgctgcgcccgacgccccggggcgccgtcatggacatcatctcccgcaaggaccagcgggggagcggccaggtggggacctacggcctgaacaccttcaccaacatggaggtgcagctcatccgccagatggaggccgagggcgtcatcacgcaggacgacatgcagaaccccaaggggctgcgggagcgcgtggagaagtggctgaaggagtgcggcgtggaccggctcaagcgcatggccatctccggggacgactgcgtcgtgaagcccctggacgagcggttcggcaccagcctcctgttcctgaacgacatggggaaggtgcgcaaggacatcccgcagtgggagccctccaagggctggaagaactggcaggaggtccccttctgcagccaccacttccacaagatcttcatgaaggacggccggtccctggtggtgccctgccgcaaccaggacgagctcatcgggcgcgcccggatcagccagggcgcggggtggtccctgcgcgagaccgcctgcctgggcaaggcctacgcccagatgtggagcctcatgtacttccaccggcgcgacctgcggctggcctccatggcgatctgcagcgccgtcccgaccgagtggttccccacgagccgcaccacctggtccatccacgcccaccaccagtggatgaccacggaggacatgctcaaggtgtggaaccgggtgtggatcgaggacaaccccaacatgaccgacaagacccccgtccacagctgggaggacatcccgtacctggggaagcgcgaggacctgtggtgcggctccctcatcggcctgagctcccgggccacctgggccaagaacatccacacggcgatcacccaggtgcgcaacctgatcgggaaggaggagtacgtggactacatgcccgtcatgaagcggtacagcgccccctccgagagcgagggcgtgctctga

SEQ ID NO: 10425 - RNA, 9867 nt, synthetic construct
  misc_feature 1..9867: note = derived and/or modified CDS sequence (opt1) from DENV-4__GQ868579__SS-prME
  source 1..9867: mol_type = other RNA
agcaccatcaccctgctctgcctgatccccacgatcatggccttccacctgtccacccgcgacggcgagccgctcatgatcgtggccaagcacgagcgggggcgccccctgctgttcaagaccaccgagggcatcaacaagtgcacgctcatcgcgatggacctgggggagatgtgcgaggacaccgtcacctacaagtgccccctgctcatcaacaccgagcccgaggacatcgactgctggtgcaacctgacgagcacctgggtgatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtcgagagctggatcctgcggaaccccggcttcgcgctgctcgccgggttcatggcctacatgatcggccagaccgggatccagcgcacggtgttcttcatcctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtgggcaacgacaccagcaaccacggggtcaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatcagctccacccccctggcggagaacacgaacagcgtgaccaacatcgagctcgagccgcccttcggggactcctacatcgtcatcggcgtgggcaacagcgccctgaccctgcactggttccggaaggggtccagcatcggcaagatgttcgagtccacctaccgcggggccaagcggatggccatcctcggcgagacggcgtgggacttcgggagcgtgggcggcctgttcacctccctggggaaggccgtccaccaggtgttcggcagcgtgtacaccaccatgttcgggggcgtctcctggatgatccgcatcctcatcgggttcctggtgctgtggatcggcacgaacagccggaacacctccatggccatgacctgcatcgccgtgggcgggatcaccctgttcctcggcttcacggtccgcgccgacatggggtgcgtggtgagctggtccggccgggagctgaagtgcgggagcggcatcttcgtcgtggacaacgtgcacacctggaccgagcagtacaagttccagcccgagagccccgcgcgcctggcctccgccatcctcaacgcccacaaggacggcgtctgcgggatccggagcaccacgcgcctggagaacgtgatgtggaagcagatcaccaacgagctgaactacgtgctctgggagggcgggcacgacctgaccgtcgtggccggcgacgtgaagggcgtcctgaccaaggggaagcgggcgctcacgccgcccgtgtccgacctgaagtacagctggaagacctggggcaaggccaagatcttcacccccgaggcccgcaactccaccttcctgatcgacgggcccgacacgagcgagtgcccgaacgagcggcgcgcctggaactccctcgaggtggaggactacggcttcgggatgttcaccaccaacatctggatgaagttccgggagggcagctccgaggtctgcgaccaccgcctgatgagcgccgcgatcaaggaccagaaggccgtgcacgccgacatgggctactggatcgagtccagcaagaaccagacctggcagatcgagcgggcctccctgatcgaggtgaagacgtgcctctggcccaagacccacaccctgtggagcaacggggtcctggagtcccagatgctcatccccaagagctacgcgggcccgttctcccagcacaactaccgccaggggtacgccacccagaccgtgggcccctggcacctggggaagctggagatcgacttcggcgagtgccccggcacgaccgtgaccatccaggaggactgcgaccaccgcgggcccagcctccggaccacgaccgccagcggcaagctggtcacccagtggtgctgccgctcctgcaccatgccgcccctgcggttcctcggggaggacggctgctggtacgggatggagatccgccccctgagcgagaaggaggagaacatggtgaagtcccaggtgacggccggccagagcacctccgagaccttcagcatgggcctgctctgcctgaccctgttcgtcgaggagtgcctccggcgccgggtgacgcgcaagcacatgatcctggccgtcgtgatcaccctgtgcgcgatcatcctcgggggcctgacctggatggacctgctccgggccctgatcatgctgggggacaccatgtccggccgcatcggcgggcagacgcacctcgccatcatggccgtgttcaagatgagccccggctacgtcctgggggtgttcctgcggaagctcacctcccgcgagaccgccctgatggtgatcggcatggcgatgaccacgaccctgagcatcccgcacgacctcatggagctgatcgacgggatctccctgggcctcatcctgctgaagatcgtcacccagttcgacaacacccaggtgggcacgctcgccctgagcctgaccttcatccggtccaccatgagcctcgtgatggcctggcgcaccatcatggccgtcctgttcgtggtgacgctgatccccctctgccggacctcctgcctgcagaagcagagccactgggtcgagatcaccgccctgatcctcggggcgcaggccctgcccgtgtacctgatgaccctcatgaagggcgcctcccgccggagctggcccctgaacgaggggatcatggccgtgggcctggtctccctcctggggagcgcgctgctcaagaacgacgtgccgctggccggccccatggtggccggcgggctgctcctggccgcctacgtcatgagcggctccagcgcggacctgtccctcgagaaggccgccaacgtgcagtgggacgagatggccgacatcacggggagctcccccatcatcgaggtgaagcaggacgaggacggcagcttctccatccgcgacgtcgaggagaccaacatgatcaccctgctggtgaagctcgccctgatcaccgtgagcgggctgtaccccctcgcgatcccggtcacgatgaccctgtggtacatgtggcaggtgaagacccagcggtccggcgccctgtgggacgtgcccagccccgccgccacccagaaggccgcgctctccgagggcgtctaccgcatcatgcagcgggggctgttcggcaagacccaggtgggggtgggcatccacatggagggggtcttccacacgatgtggcacgtgacccgcggcagcgtgatctgccacgagaccggccgcctggagccctcctgggccgacgtccggaacgacatgatcagctacgggggcgggtggcgcctcggcgacaagtgggaccgggaggaggacgtgcaggtgctggccatcgagccgggcaagaaccccaagcacgtccagaccaagcccgggctgttcaagacgctcaccggcgagatcggggccgtgaccctggacttcaagcccggcacctccgggagcccgatcatcaacaagaagggcaaggtgatcggcctgtacgggaacggcgtcgtgacgaagtccggggactacgtgagcgccatcacccaggcggagcgcatcggcgagcccgactacgaggtcgacgaggacatcttccggaagaagcgcctcaccatcatggacctgcaccccggggccggcaagaccaagcggatcctgccgtccatcgtgcgcgaggccctgaagcggcgcctccggacgctgatcctggcccccacccgcgtggtcgcggccgagatggaggaggccctccggggcctgcccatccgctaccagacccccgccgtgaagagcgagcacaccgggcgggagatcgtggacctgatgtgccacgccacgttcaccacccgcctcctgagctccacccgggtcccgaactacaacctgatcgtgatggacgaggcgcacttcacggaccccagctccgtggccgcccgcggctacatcagcacccgggtcgagatgggggaggccgccgcgatcttcatgaccgccaccccccccggcgccacggacccgttcccccagtccaacagccccatcgaggacatcgagcgcgagatccccgagcgctcctggaacaccgggttcgactggatcaccgactaccagggcaagaccgtgtggttcgtcccgagcatcaaggccggcaacgacatcgccaactgcctccggaagtccgggaagaaggtgatccagctgagccgcaagacgttcgacaccgagtaccccaagaccaagctgaccgactgggacttcgtggtcacgaccgacatctccgagatgggcgcgaacttccgggccgggcgcgtgatcgacccccggcgctgcctcaagcccgtgatcctgaccgacggcccggagcgggtcatcctggccgggcccatccccgtgacccccgccagcgcggcccagcgccggggccgcatcggccggaacccggcccaggaggacgaccagtacgtgttctccggggaccccctcaagaacgacgaggaccacgcccactggacggaggccaagatgctgctggacaacatctacacccccgagggcatcatccccaccctcttcgggccggagcgcgagaagacccaggcgatcgacggcgagttccggctgcgcggcgagcagcggaagacgttcgtcgagctgatgcgccggggggacctccccgtgtggctgagctacaaggtggcctccgccggcatcagctacaaggaccgcgagtggtgcttcaccggggagcggaacaaccagatcctggaggagaacatggaggtcgagatctggacccgcgagggcgagaagaagaagctccggccccgctggctggacgcccgcgtgtacgccgaccccatggcgctgaaggacttcaaggagttcgcctccgggcggaagagcatcaccctcgacatcctgaccgagatcgcctccctgccgacgtacctcagcagccgcgccaagctggccctggacaacatcgtgatgctccacaccaccgagcggggcggccgcgcgtaccagcacgccctgaacgagctgcccgagtccctcgagaccctgatgctggtcgccctcctgggggccatgacggcgggcaccttcctgttcttcatgcaggggaagggcatcgggaagctcagcatgggcctgatcaccatcgccatggcctccggcctgctctggatcgccgagatccagccccagtggatcgccgcgagcatcatcctggagttcttcctgatggtgctcctgatcccggagcccgagaagcagcggaccccccaggacaaccagctgatctacgtgatcctcacgatcctggccatcatcgggctgatcgccgccaacgagatgggcctcatcgagaagaccaagaccgacttcgggttctaccaggtcaagaccgagacgaccatcctggacgtggacctgcgccccgcctccgcgtggaccctctacgccgtggccaccacgatcctgaccccgatgctgcggcacaccatcgagaacaccagcgccaacctctccctggccgcgatcgccaaccaggccgccgtcctgatgggcctcgggaagggctggcccctgcaccgcatggacctgggcgtgcccctcctggccatggggtgctacagccaggtgaaccccacgaccctgaccgcgtccctcgtcatgctgctggtgcactacgccatcatcggcccggggctccaggccaaggccacccgggaggcgcagaagcgcacggccgccggcatcatgaagaaccccaccgtggacggcatcaccgtcatcgacctggagcccatcagctacgaccccaagttcgagaagcagctggggcaggtgatgctcctggtgctgtgcgccggccagctcctgctgatgcggaccacgtgggccttctgcgaggtcctcaccctggcgaccgggccgatcctgaccctctgggagggcaaccccgggcgcttctggaacacgaccatcgccgtgtccaccgccaacatcttccggggcagctacctggccggcgccgggctggcgttctccctcatcaagaacgcccaggccccccgccggggcaccgggacgaccggcgagaccctgggggagaagtggaagcgccagctgaacagcctcgaccggaaggagttcgaggagtacaagcgctccggcatcctggaggtggaccggaccgaggccaagagcgccctgaaggacggctccaagatcaagcacgcggtcagccgcgggtccagcaagatccgctggatcgtggagcggggcatggtgaagcccaaggggaaggtcgtggacctcggctgcgggcgcggcggctggagctactacatggccaccctgaagaacgtgacggaggtcaaggggtacaccaagggcgggccgggccacgaggagcccatccccatggccacctacgggtggaacctggtgaagctccactccggcgtggacgtcttctacaagcccaccgagcaggtggacacgctgctgtgcgacatcggcgagagctccagcaacccgaccatcgaggaggggcggaccctccgcgtgctgaagatggtcgagccctggctgtccagcaagcccgagttctgcatcaaggtgctgaacccctacatgccgaccgtgatcgaggagctcgagaagctgcagcggaagcacggcgggaacctggtccgctgccccctctcccggaacagcacgcacgagatgtactgggtgtccggcgccagcggcaacatcgtgtccagcgtcaacaccacctccaagatgctgctgaaccgcttcaccacgcggcaccgcaagcccacctacgagaaggacgtggacctcggggcgggcacccggagcgtctccaccgagacggagaagcccgacatgaccatcatcgggcgccggctgcagcgcctgcaggaggagcacaaggagacctggcactacgaccaggagaacccgtaccggacctgggcctaccacggcagctacgaggccccctccacggggagcgcctccagcatggtgaacggcgtggtcaagctcctgaccaagccctgggacgtgatcccgatggtgacccagctggccatgaccgacacgacccccttcggccagcagcgcgtcttcaaggagaaggtggacacccggaccccccagcccaagccggggacgcgcatggtgatgaccaccaccgcgaactggctctgggccctgctgggcaagaagaagagcccccggctctgcacgcgcgaggagttcatctccaaggtccggagcaacgccgccatcggggccgtgttccaggaggagcagggctggacctccgcgagcgaggccgtgaacgactcccgcttctgggagctggtcgacaaggagcgcgccctgcaccaggaggggaagtgcgagagctgcgtgtacaacatgatgggcaagcgggagaagaagctcggcgagttcgggcgcgccaagggctcccgggccatctggtacatgtggctgggggcgcgcttcctggagttcgaggccctcggcttcctgaacgaggaccactggttcgggcgggagaacagctggtccggcgtggagggcgaggggctgcaccgcctcggctacatcctggaggagatcgacaagaaggacggggacctgatgtacgccgacgacaccgccggctgggacacccggatcacggaggacgacctccagaacgaggagctgatcaccgagcagatggcgccccaccacaagatcctggccaaggccatcttcaagctcacctaccagaacaaggtcgtgaaggtgctgcgccccaccccgcggggcgccgtcatggacatcatcagccgcaaggaccagcgggggtccggccaggtggggacctacggcctgaacacgttcaccaacatggaggtgcagctcatccgccagatggaggccgagggggtcatcacccaggacgacatgcagaaccccaagggcctgaaggagcgggtggagaactggctgcgcgagtgcggcgtggaccggctcaagcgcatggcgatcagcggggacgactgcgtcgtgaagcccctggacgagcggttcggcacctccctgctcttcctgaacgacatggggaaggtgcgcaaggacatcccccagtgggagccgagcaagggctggaagaactggcaggaggtccccttctgctcccaccacttccacaagatcttcatgaaggacgggcggagcctggtggtgccctgccgcaaccaggacgagctcatcggccgcgcccggatctcccagggcgccgggtggagcctgcgcgagacggcctgcctgggcaaggcctacgcgcagatgtggagcctcatgtacttccaccggcgcgacctgcggctggcctccatggccatctgcagcgccgtccccaccgagtggttcccgacctcccgcaccacgtggagcatccacgcccaccaccagtggatgaccaccgaggacatgctcaaggtgtggaaccgggtgtggatcgaggacaaccccaacatgatcgacaagacccccgtccactcctgggaggacatcccctacctggggaagcgcgaggacctgtggtgcggcagcctcatcgggctgtccagccgggcgacgtgggccaagaacatccacaccgccatcacccaggtgcgcaacctgatcggcaaggaggagtacgtggactacatgccggtcatgaagcggtactccgcccccagcgagtccgagggcgtgctctga

SEQ ID NO: 10426 - RNA, 9867 nt, synthetic construct
  misc_feature 1..9867: note = derived and/or modified CDS sequence (opt1) from DENV-4__GQ868580__SS-prME
  source 1..9867: mol_type = other RNA
agcaccatcaccctgctctgcctgatccccacgatcatggccttccacctgtccacccgcgacggcgagccgctcatgatcgtggccaagcacgagcgggggcgccccctgctgttcaagaccaccgagggcatcaacaagtgcacgctcatcgcgatggacctgggggagatgtgcgaggacaccgtcacctacaagtgccccctgctcatcaacaccgagcccgaggacatcgactgctggtgcaacctgacgagcacctgggtgatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtcgagagctggatcctgcggaaccccggcttcgcgctgctcgccgggttcatggcctacatgatcggccagaccgggatccagcgcacggtgttcttcgtgctgatgatgctggtcgccccctcctacggcatgcggtgcgtgggcgtggggaaccgcgacttcgtcgagggcgtgagcgggggcgcgtgggtggacctcgtcctggagcacggcgggtgcgtgaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtcgtggaccggggctgggggaacggctgcggcctgttcgggaagggcggggtggtcacgtgcgccaagttcagctgctccggcaagatcaccgggaacctcgtgcagatcgagaacctggagtacaccgtggtcgtgaccgtgcacaacggcgacacgcacgccgtcggcaacgacaccagcaaccacggggtgaccgccaccatcacgccccgctcccccagcgtcgaggtgaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtccactggaactacaaggagcgcatggtgacgttcaaggtgccgcacgccaagcggcaggacgtcaccgtgctggggtcccaggagggcgccatgcacagcgccctggccggcgcgaccgaggtggacagcggggacggcaaccacatgttcgccgggcacctcaagtgcaaggtccgcatggagaagctgcgcatcaagggcatgtcctacaccatgtgcagcggcaagttctccatcgacaaggagatggccgagacgcagcacgggaccaccgtggtgaaggtcaagtacgagggcgccggggccccctgcaaggtgcccatcgagatccgggacgtgaacaaggagaaggtcgtgggccgcatcatcagctccacccccctggcggagaacacgaacagcgtgaccaacatcgagctcgagccgcccttcggggactcctacatcgtcatcggcgtgggcaacagcgccctgaccctgcactggttccggaaggggtccagcatcggcaagatgttcgagtccacctaccgcggggccaagcggatggccatcctcggcgagacggcgtgggacttcgggagcgtgggcggcctgttcacctccctggggaaggccgtccaccaggtgttcggcagcgtgtacaccaccatgttcgggggcgtctcctggatgatccgcatcctcatcgggttcctggtgctgtggatcggcacgaacagccggaacacctccatggccatgacctgcatcgccgtgggcgggatcaccctgttcctcggcttcacggtccaggccgacatggggtgcgtggtgagctggtccggccgcgagctgaagtgcgggagcggcatcttcgtcgtggacaacgtgcacacctggaccgagcagtacaagttccagcccgagagccccgcgcggctggcctccgccatcctcaacgcccacaaggacggcgtctgcgggatccgcagcaccacgcggctggagaacgtgatgtggaagcagatcaccaacgagctgaactacgtgctctgggagggcgggcacgacctgaccgtcgtggccggcgacgtgaagggcgtcctgaccaaggggaagcgcgcgctcacgccgcccgtgtccgacctgaagtacagctggaagacctggggcaaggccaagatcttcacccccgaggcccggaactccaccttcctgatcgacgggcccgacacgagcgagtgcccgaacgagcgccgggcctggaactccctcgaggtggaggactacggcttcgggatgttcaccaccaacatctggatgaagttccgcgagggcagctccgaggtctgcgaccaccggctgatgagcgccgcgatcaaggaccagaaggccgtgcacgccgacatgggctactggatcgagtccagcaagaaccagacctggcagatcgagcgcgcctccctgatcgaggtgaagacgtgcctctggcccaagacccacaccctgtggagcaacggggtcctggagtcccagatgctcatccccaagagctacgcgggcccgttctcccagcacaactaccggcaggggtacgccacccagaccgtgggcccctggcacctggggaagctggagatcgacttcggcgagtgccccggcacgaccgtgaccatccaggaggactgcgaccaccgcgggcccagcctccgcaccacgaccgccagcggcaagctggtcacccagtggtgctgccggtcctgcaccatgccgcccctgcgcttcctcggggaggacggctgctggtacgggatggagatccggcccctgaacgagaaggaggagaacatggtgaagagccaggtgacggccggccagtccaccagcgagaccttctccatgggcctgctctgcctgaccctgttcgtcgaggagtgcctccgccggcgcgtgacgcggaagcacatgatcctggccgtcgtgatcaccctgtgcgcgatcatcctcgggggcctgacctggatggacctgctccgcgccctgatcatgctgggggacaccatgagcggccggatcggcgggcagacgcacctcgccatcatggccgtgttcaagatgtcccccggctacgtcctgggggtgttcctgcgcaagctcaccagccgggagaccgccctgatggtgatcggcatggcgatgaccacgaccttctccatcccgcacgacctgatggagctcatcgacgggatcagcctgggcctgatcctcctgaagatcgtcacccagttcgacaacacccaggtgggcacgctggccctctccctgaccttcatccgcagcaccatgtccctggtgatggcctggcggaccatcatggccgtcctcttcgtggtgacgctgatccccctgtgccgcaccagctgcctccagaagcagtcccactgggtcgagatcaccgccctgatcctgggggcgcaggccctccccgtgtacctgatgaccctgatgaagggcgccagccggcgctcctggcccctcaacgaggggatcatggccgtgggcctggtcagcctgctcgggtccgcgctgctgaagaacgacgtgccgctcgccggccccatggtggccggcgggctgctgctcgccgcctacgtcatgagcggcagctccgcggacctgagcctggagaaggccgccaacgtgcagtgggacgagatggccgacatcacggggtccagccccatcatcgaggtgaagcaggacgaggacggctccttcagcatccgggacgtcgaggagaccaacatgatcaccctcctggtgaagctggccctcatcaccgtgtccgggctgtaccccctggcgatcccggtcacgatgaccctctggtacatgtggcaggtgaagacccagcgcagcggcgccctgtgggacgtgccctcccccgccgccacccagaaggccgcgctgagcgagggcgtctaccggatcatgcagcgcgggctcctgggcaagacccaggtgggggtgggcatccacatggagggggtcttccacacgatgtggcacgtgacccggggctccgtgatctgccacgagaccggccgcctggagcccagctgggccgacgtccgcaacgacatgatctcctacgggggcgggtggcggctcggcgacaagtgggaccgcgaggaggacgtgcaggtgctggccatcgagccgggcaagaaccccaagcacgtccagaccaagcccgggctgttcaagacgctcaccggcgagatcggggccgtgaccctggacttcaagcccggcaccagcgggtccccgatcatcaaccggaagggcaaggtgatcggcctgtacgggaacggcgtcgtgacgaagagcggggactacgtgtccgccatcacccaggcggagcgcatcggcgagcccgactacgaggtcgacgaggacatcttccggaagaagcgcctcaccatcatggacctgcaccccggggccggcaagaccaagcggatcctgccgagcatcgtgcgcgaggccctgaagcggcgcctccggacgctgatcctggcccccacccgcgtggtcgcggccgagatggaggaggccctccggggcctgcccatccgctaccagacccccgccgtgaagtccgagcacaccgggcgggagatcgtggacctgatgtgccacgccacgttcaccacccgcctcctgagcagcacccgggtcccgaactacaacctgatcgtgatggacgaggcgcacttcacggacccctccagcgtggccgcccgcggctacatctccacccgggtcgagatgggggaggccgccgcgatcttcatgaccgccaccccccccggcgccacggacccgttcccccagagcaactcccccatcgaggacatcgagcgcgagatccccgagcgcagctggaacaccgggttcgactggatcaccgactaccagggcaagaccgtgtggttcgtcccgtccatcaaggccggcaacgacatcgccaactgcctccggaagagcgggaagaaggtgatccagctgtcccgcaagacgttcgacaccgagtaccccaagaccaagctgaccgactgggacttcgtggtcacgaccgacatcagcgagatgggcgcgaacttccgggccgggcgcgtgatcgacccccggcgctgcctcaagcccgtgatcctgaccgacggcccggagcgggtcatcctggccgggcccatccccgtgacccccgcctccgcggcccagcgccggggccgcatcggccggaacccggcccaggaggacgaccagtacgtgttcagcggggaccccctcaagaacgacgaggaccacgcccactggacggaggccaagatgctgctggacaacatctacacccccgagggcatcatccccaccctcttcgggccggagcgcgagaagacccaggcgatcgacggcgagttccggctgcgcggcgagcagcggaagacgttcgtcgagctgatgcgccggggggacctccccgtgtggctgtcctacaaggtggccagcgccggcatctcctacaaggaccgcgagtggtgcttcaccggggagcggaacaaccagatcctggaggagaacatggaggtcgagatctggacccgcgagggcgagaagaagaagctccggccccgctggctggacgcccgcgtgtacgccgaccccatggcgctgaaggacttcaaggagttcgccagcgggcggaagtccatcaccctcgacatcctgaccgagatcgccagcctgccgacgtacctctccagccgcgccaagctggccctggacaacatcgtgatgctccacaccaccgagcggggcggccgcgcgtaccagcacgccctgaacgagctgcccgagagcctcgagaccctgatgctggtcgccctcctgggggccatgacggcgggcatcttcctgttcttcatgcaggggaagggcatcgggaagctctccatgggcctgatcaccatcgccatggccagcggcctgctctggatcgccgagatccagccccagtggatcgccgcgtccatcatcctggagttcttcctgatggtgctcctgatcccggagcccgagaagcagcggaccccccaggacaaccagctgatctacgtgatcctcaccatcctgacgatcatcgggctgatcgccgccaacgagatgggcctcatcgagaagaccaagaccgacttcgggttctaccaggtcaagaccgagacgaccatcctggacgtggacctgcgccccgccagcgcctggaccctctacgcggtggccaccacgatcctgaccccgatgctgcggcacaccatcgagaacacctccgccaacctcagcctggccgccatcgcgaaccaggccgccgtcctgatgggcctcgggaagggctggcccctgcaccgcatggacctgggcgtgcccctcctggccatggggtgctactcccaggtgaaccccacgaccctgaccgccagcctcgtcatgctgctggtgcactacgcgatcatcggcccggggctccaggccaaggccacccgggaggcccagaagcgcacggcggccggcatcatgaagaaccccaccgtggacggcatcaccgtcatcgacctggagcccatctcctacgaccccaagttcgagaagcagctggggcaggtgatgctcctggtgctgtgcgccggccagctcctgctgatgcggaccacgtgggccttctgcgaggtcctcaccctggccaccgggccgatcctgaccctctgggagggcaaccccgggcgcttctggaacacgaccatcgcggtgagcaccgccaacatcttccggggctcctacctggccggcgccgggctggccttcagcctcatcaagaacgcgcagaccccccgccggggcacggggaccaccggcgagaccctgggggagaagtggaagcgccagctgaactccctcgaccggaaggagttcgaggagtacaagcgcagcggcatcctggaggtggaccggaccgaggccaagtccgccctgaaggacggcagcaagatcaagcacgccgtctcccgcgggagctccaagatccgctggatcgtggagcggggcatggtgaagcccaaggggaaggtcgtggacctcggctgcgggcgcggcggctggagctactacatggccacgctgaagaacgtgaccgaggtcaaggggtacaccaagggcgggccgggccacgaggagcccatccccatggcgacctacgggtggaacctggtgaagctccacagcggcgtggacgtcttctacaagcccacggagcaggtggacaccctgctgtgcgacatcggcgagtccagctccaacccgaccatcgaggaggggcggaccctccgcgtgctgaagatggtcgagccctggctgagctccaagcccgagttctgcatcaaggtgctgaacccctacatgccgacggtgatcgaggagctcgagaagctgcagcggaagcacggcgggaacctggtccgctgccccctcagccggaactccacccacgagatgtactgggtgagcggcgcctccggcaacatcgtgagctccgtcaacaccaccagcaagatgctgctgaaccgcttcacgacccggcaccgcaagcccacctacgagaaggacgtggacctcggggccggcacccggtccgtcagcacggagaccgagaagcccgacatgaccatcatcgggcgccggctgcagcgcctgcaggaggagcacaaggagacctggcactacgaccaggagaacccgtaccggacgtgggcctaccacggctcctacgaggcgcccagcaccgggtccgccagctccatggtgaacggcgtggtcaagctcctgaccaagccctgggacgtgatcccgatggtgacccagctggccatgacggacaccacccccttcggccagcagcgcgtcttcaaggagaaggtggacacccggacgccccagcccaagccggggacccgcatggtgatgaccaccacggccaactggctctgggccctgctgggcaagaagaagagcccccggctctgcacccgcgaggagttcatcagcaaggtccggtccaacgcggccatcggggccgtgttccaggaggagcagggctggaccagcgcctccgaggccgtgagcgactcccgcttctgggagctggtcgacaaggagcgcgcgctgcaccaggaggggaagtgcgagagctgcgtgtacaacatgatgggcaagcgggagaagaagctcggcgagttcgggcgcgccaagggctcccgggccatctggtacatgtggctgggggcccgcttcctggagttcgaggccctcggcttcctgaacgaggaccactggttcgggcgggagaacagctggtccggcgtggagggcgaggggctgcaccgcctcggctacatcctggaggagatcgacaagaaggacggggacctgatgtacgcggacgacaccgccggctgggacacgcggatcaccgaggacgacctccagaacgaggagctgatcaccgagcagatggccccccaccacaagatcctggccaaggcgatcttcaagctcacctaccagaacaaggtcgtgaaggtgctgcgccccaccccgcggggcgccgtcatggacatcatcagccgcaaggaccagcgggggtccggccaggtggggacgtacagcctgaacaccttcaccaacatggaggtgcagctcatccgccagatggaggccgagggcgtcatcacccaggacgacatgcagaaccccaaggggctgaaggagcgggtggagaactggctgcgcgagtgcggcgtggaccggctcaagcgcatggccatctccggcgacgactgcgtcgtgaagcccctggacgagcggttcgggacgagcctgctcttcctgaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctcatcgggcgcgcccggatcagccagggcgcgggctggagcctgcgcgagaccgcctgcctggggaaggcctacgcccagatgtggtccctcatgtacttccaccggcgcgacctgcggctggccagcatggcgatctgctccgccgtccccaccgagtggttcccgaccagccgcacgacctggtccatccacgcccaccaccagtggatgaccaccgaggacatgctcaaggtgtggaaccgggtgtggatcgaggacaaccccaacatgatcgacaagacgcccgtccacagctgggaggacatcccctacctgggcaagcgcgaggacctgtggtgcgggtccctcatcggcctgagctcccgggccacctgggccaagaacatccacaccgcgatcacccaggtgcgcaacctgatcgggaaggaggagtacgtggactacatgccggtcatgaagcggtacagcgccccctccgagagcgagggcgtgctctga

SEQ ID NO: 10427 - RNA, 9867 nt, synthetic construct
  misc_feature 1..9867: note = derived and/or modified CDS sequence (opt1) from DENV-4__GQ868583__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcatgatcggcgtcggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtgcaccaggtcttcggctccgtgtacaccacgatgttcgggggcgtgagctggatgatccgcatcctcatcgggttcctggtcctgtggatcggcaccaactcccggaacaccagcatggccatgacctgcatcgccgtgggcgggatcacgctgttcctcggcttcaccgtgcaggccgacatggggtgcgtcgtgtcctggagcggccgcgagctgaagtgcgggtccggcatcttcgtggtcgacaacgtgcacacctggaccgagcagtacaagttccagcccgagagccccgcgcggctggccagcgccatcctcaacgcccacaaggacggcgtgtgcgggatccgctccacgacccggctggagaacgtcatgtggaagcagatcaccaacgagctgaactacgtgctctgggagggcgggcacgacctgaccgtggtcgccggcgacgtgaagggcgtgctgacgaaggggaagcgcgcgctcgccccgcccgccagcgacctgaagtactcctggaagacctggggcaaggccaagatcttcacccccgaggcccggaacagcaccttcctgatcgacgggcccgacacgtccgagtgcccgaacgagcgccgggcgtggaacagcttcgaggtcgaggactacggcttcgggatgttcaccaccaacatctggatgaagttccgcgagggctccagcgaggtgtgcgaccaccggctcatgtccgccgccatcaaggaccagaaggccgtgcacgcggacatgggctactggatcgagagctccaagaaccagacctggcagatcgagcgcgccagcctgatcgaggtcaagacgtgcctgtggcccaagacccacaccctctggtccaacggggtgctggagagccagatgctgatccccaagtcctacgccggcccgttcagccagcacaactaccggcaggggtacgccacccagaccgtgggcccctggcacctcgggaagctggagatcgacttcggcgagtgccccggcacgaccgtcaccatccaggaggactgcgaccaccgcgggccctccctgcgcaccacgaccgccagcggcaagctcgtgacccagtggtgctgccggagctgcaccatgccgcccctgcgcttcctgggggaggacggctgctggtacgggatggagatccggcccctctccgagaaggaggagaacatggtgaagagccaggtcacggcgggccagggcacctccgagaccttcagcatggggctgctgtgcctcaccctgttcgtggaggagtgcctgcgccggcgcgtcacgcggaagcacatgatcctcgccgtggtgatcaccctgtgcgccatcatcctgggcgggctcacctggatggacctgctgcgcgccctcatcatgctgggcgacaccatgtccggccggatcgggggccagacgcacctggccatcatggcggtcttcaagatgagccccgggtacgtgctcggcgtgttcctgcgcaagctgacctcccgggagaccgccctcatggtcatcgggatggccatgaccacgaccctgagcatcccgcacgacctgatggagctcatcgacggcatctccctgggcctgatcctcctgaagatcgtgacccagttcgacaacacccaggtggggacgctggccctcagcctgaccttcatccgctccaccatgagcctggtcatggcctggcggaccatcatggcggtgctcttcgtggtcacgctgatccccctgtgccgcacctcctgcctccagaagcagagccactgggtggagatcaccgccctgatcctgggcgcccaggccctccccgtgtacctgatgaccctgatgaagggggcgtcccggcgcagctggcccctcaacgagggcatcatggccgtcgggctggtgtccctgctcggcagcgccctgctgaagaacgacgtgccgctcgccggccccatggtcgccgggggcctgctgctcgcggcctacgtgatgtccgggagcagcgccgacctgtccctggagaaggccgccaacgtgcagtgggacgagatggcggacatcacgggcagctcccccatcatcgaggtcaagcaggacgaggacgggagcttctccatccgggacgtggaggagaccaacatgatcaccctcctggtgaagctggccctcatcaccgtcagcggcctgtaccccctggccatcccggtgacgatgaccctctggtacatgtggcaggtgaagacccagcgctccggcgccctgtgggacgtccccagccccgccgcgacccagaaggccgccctgtccgagggggtgtaccggatcatgcagcgcggcctcttcgggaagacccaggtgggcgtcgggatccacatggagggcgtgttccacacgatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagaccaagcccggcctgttcaagacgctgaccggggagatcggcgcggtgaccctcgacttcaagcccgggacctccggcagcccgatcatcaaccgcaagggcaaggtcatcgggctgtacggcaacggggtggtgacgaagtccggcgactacgtcagcgccatcacccaggccgagcggatcggggagcccgactacgaggtggacgaggacatcttccgcaagaagcggctgaccatcatggacctccaccccggcgccggcaagaccaagcgcatcctgccgtccatcgtgcgggaggcgctgaagcgccggctgcgcacgctcatcctggcccccacccgggtcgtggccgccgagatggaggaggccctgcgcgggctccccatccggtaccagacccccgcggtgaagagcgagcacaccggccgcgagatcgtcgacctgatgtgccacgccacgttcaccacccggctgctctccagcacccgcgtgccgaactacaacctgatcgtgatggacgaggcccacttcacggaccccagctccgtcgccgcccgggggtacatcagcacccgcgtggagatgggcgaggcggccgccatcttcatgaccgccaccccccccggggccacggacccgttcccccagtccaacagccccatcgaggacatcgagcgggagatccccgagcgctcctggaacaccggcttcgactggatcaccgactaccagggcaagaccgtctggttcgtgccgagcatcaaggcggggaacgacatcgccaactgcctgcgcaagtccggcaagaaggtgatccagctcagccggaagacgttcgacaccgagtaccccaagaccaagctgaccgactgggacttcgtcgtgacgaccgacatctccgagatgggggccaacttccgcgccggccgggtgatcgacccccgccggtgcctgaagcccgtcatcctcaccgacgggccggagcgcgtgatcctggcgggccccatccccgtgacccccgccagcgccgcccagcggcgcggccggatcgggcgcaacccggcccaggaggacgaccagtacgtcttctccggcgaccccctgaagaacgacgaggaccacgcgcactggacggaggccaagatgctcctggacaacatctacacccccgaggggatcatccccaccctgttcggcccggagcgggagaagacccaggccatcgacggcgagttccgcctccggggggagcagcgcaagacgttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcgcgggtgtacgccgaccccatggccctgcaggacttcaaggagttcgcctccggccgcaagagcatcaccctggacatcctcaccgagatcgcctccctgccgacgtacctgagctcccgcgcgaagctcgccctggacaacatcgtcatgctgcacaccaccgagcggggcgggcgcgcctaccagcacgccctcaacgagctgcccgagagcctggagaccctcatgctggtggcgctgctcggcgccatgacggccgggatcttcctgttcttcatgcagggcaaggggatcggcaagctgagcatgggcctcatcaccatcgccgtggcctccgggctgctgtgggtcgcggagatccagccccagtggatcgccgccagcatcatcctcgagttcttcctgatggtgctgctcatcccggagcccgagaagcagcggaccccccaggacaaccagctgatctacgtgatcctgaccatcctcacgatcatcggcctgatcgccgccaacgagatggggctgatcgagaagaccaagaccgacttcggcttctaccaggtcaagaccgagacgaccatcctcgacgtggacctgcgccccgcgtccgcctggaccctgtacgccgtggccaccacgatcctcaccccgatgctgcggcacaccatcgagaacaccagcgccaacctgtccctcgcggccatcgccaaccaggccgccgtcctgatggggctgggcaagggctggcccctccaccgcatggacctgggggtgcccctgctcgcgatgggctgctacagccaggtgaaccccacgaccctgaccgcctccctggtcatgctcctggtgcactacgccatcatcgggccgggcctgcaggccaaggcgacccgggaggcccagaagcgcacggccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggaccacgtgggcgttctgcgaggtcctgaccctcgccaccggcccgatcctgaccctgtgggaggggaaccccggccgcttctggaacacgaccatcgccgtgtccaccgccaacatcttccggggcagctacctcgccggggcgggcctggccttctccctgatcaagaacgcccagaccccccgccgggggacgggcaccaccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgagcgactcccgcttctgggagctcgtcgacaaggagcgggccctgcaccaggagggcaagtgcgagagctgcgtgtacaacatgatgggcaagcgcgagaagaagctgggggagttcggccgcgccaaggggtcccgggccatctggtacatgtggctcggcgcgcgcttcctggagttcgaggccctggggttcctcaacgaggaccactggttcggccgggagaacagctggtccggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatcagccgcaaggaccagcggggctccgggcaggtgggcacgtacgggctgaacaccttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatcagcggcgacgactgcgtcgtgaagcccctcgacgagcggttcgggacgtccctgctgttcctcaacgacatgggcaaggtgcgcaaggacatcccccagtgggagccgagcaaggggtggaagaactggcaggaggtccccttctgctcccaccacttccacaagatcttcatgaaggacggccggagcctggtggtgccctgccgcaaccaggacgagctgatcggccgggcccgcatctcccagggggccggctggagcctccgcgagaccgcctgcctggggaaggcctacgcgcagatgtggtccctgatgtacttccaccggcgcgacctccggctggccagcatggccatctgcagcgccgtccccaccgagtggttcccgacctcccgcacgacctggagcatccacgcccaccaccagtggatgaccaccgaggacatgctgaaggtgtggaaccgggtgtggatcgaggacaaccccaacatgatcgacaagacgcccgtccactcctgggaggacatcccctacctcggcaagcgcgaggacctgtggtgcgggagcctgatcggcctctccagccgggcgacctgggccaagaacatccacaccgccatcacccaggtgcgcaacctgatcggcaaggaggagtacgtggactacatgccggtcatgaagcggtactccgcccccagcgagtccgagggggtgctgtga

SEQ ID NO: 10428 - RNA, 9867 nt, synthetic construct
  misc_feature 1..9867: note = derived and/or modified CDS sequence (opt1) from DENV-4__GQ868584__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccggcagtacatctgccgccgggacgtggtcgaccgcggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccggtcccccagcgtggaggtcaagctgccggactacggcgagctcaccctggactgcgagccccgctccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcggatggtcaccttcaaggtgccgcacgcgaagcgccaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcggatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgcgacgtgaacaaggagaaggtggtcggccgggtgatcagcgccacgcccctggcggagaacaccaactccgtgaccaacatcgagctcgagccgcccttcggggacagctacatcatgatcggcgtcggcaactccgccctgaccctgcactggttccgcaaggggagctccatcggcaagatgttcgagagcacgtaccggggggccaagcgcatggccatcctcggcgagaccgcgtgggacttcgggtccgtgggcggcctgttcaccagcctggggaaggccgtgcaccaggtcttcggctccgtgtacaccacgatgttcgggggcgtgagctggatgatccggatcctcatcgggttcctggtcctgtggatcggcaccaactcccgcaacaccagcatggccatgacctgcatcgccgtgggcgggatcacgctgttcctcggcttcaccgtgcaggccgacatggggtgcgtcgtgtcctggagcggccgggagctgaagtgcgggtccggcatcttcgtggtcgacaacgtgcacacctggaccgagcagtacaagttccagcccgagagccccgcgcgcctggccagcgccatcctcaacgcccacaaggacggcgtgtgcgggatccggtccacgacccgcctggagaacgtcatgtggaagcagatcaccaacgagctgaactacgtgctctgggagggcgggcacgacctgaccgtggtcgccggcgacgtgaagggcgtgctgacgaaggggaagcgggcgctcgccccgcccgccagcgacctgaagtactcctggaagacctggggcaaggccaagatcttcacccccgaggcccgcaacagcaccttcctgatcgacgggcccgacacgtccgagtgcccgaacgagcggcgcgcgtggaacagcttcgaggtcgaggactacggcttcgggatgttcaccaccaacatctggatgaagttccgggagggctccagcgaggtgtgcgaccaccgcctcatgtccgccgccatcaaggaccagaaggccgtgcacgcggacatgggctactggatcgagagctccaagaaccagacctggcagatcgagcgggccagcctgatcgaggtcaagacgtgcctgtggcccaagacccacaccctctggtccaacggggtgctggagagccagatgctgatccccaagtcctacgccggcccgttcagccagcacaactaccgccaggggtacgccacccagaccgtgggcccctggcacctcgggaagctggagatcgacttcggcgagtgccccggcacgaccgtcaccatccaggaggactgcgaccaccgcgggccctccctgcggaccacgaccgccagcggcaagctcgtgacccagtggtgctgccgcagctgcaccatgccgcccctgcggttcctgggggaggacggctgctggtacgggatggagatccgccccctctccgagaaggaggagaacatggtgaagagccaggtcacggcgggccagggcacctccgagaccttcagcatggggctgctgtgcctcaccctgttcgtggaggagtgcctgcggcgccgggtcacgcgcaagcacatgatcctcgccgtggtgatcaccctgtgcgccatcatcctgggcgggctcacctggatggacctgctgcgggccctcatcatgctgggcgacaccatgtccggccgcatcgggggccagacgcacctggccatcatggcggtcttcaagatgagccccgggtacgtgctcggcgtgttcctgcggaagctgacctcccgcgagaccgccctcatggtcatcgggatggccatgaccacgaccctgagcatcccgcacgacctgatggagctcatcgacggcatctccctgggcctgatcctcctgaagatcgtgacccagttcgacaacacccaggtggggacgctggccctcagcctgaccttcatccggtccaccatgagcctggtcatggcctggcgcaccatcatggcggtgctcttcgtggtcacgctgatccccctgtgccggacctcctgcctccagaagcagagccactgggtggagatcaccgccctgatcctgggcgcccaggccctccccgtgtacctgatgaccctgatgaagggggcgtcccgccggagctggcccctcaacgagggcatcatggccgtcgggctggtgtccctgctcggcagcgccctgctgaagaacgacgtgccgctcgccggccccatggtcgccgggggcctgctgctcgcggcctacgtgatgtccgggagcagcgccgacctgtccctggagaaggccgccaacgtgcagtgggacgagatggcggacatcacgggcagctcccccatcatcgaggtcaagcaggacgaggacgggagcttctccatccgcgacgtggaggagaccaacatgatcaccctcctggtgaagctggccctcatcaccgtcagcggcctgtaccccctggccatcccggtgacgatgaccctctggtacatgtggcaggtgaagacccagcggtccggcgccctgtgggacgtccccagccccgccgcgacccagaaggccgccctgtccgagggggtgtaccgcatcatgcagcggggcctcttcgggaagacccaggtgggcgtcgggatccacatggagggcgtgttccacacgatgtggcacgtgacccgcggcagcgtcatctgccacgagaccgggcgcctggagccctcctgggccgacgtgcggaacgacatgatcagctacggcgggggctggcgcctgggcgacaagtgggacaaggaggaggacgtgcaggtcctcgccatcgagccggggaagaaccccaagcacgtgcagaccaagcccggcctgttcaagacgctgaccggggagatcggcgcggtgaccctcgacttcaagcccgggacctccggcagcccgatcatcaaccggaagggcaaggtcatcgggctgtacggcaacggggtggtgacgaagtccggcgactacgtcagcgccatcacccaggccgagcgcatcggggagcccgactacgaggtggacgaggacatcttccggaagaagcgcctgaccatcatggacctccaccccggcgccggcaagaccaagcggatcctgccgtccatcgtgcgcgaggcgctgaagcggcgcctgcggacgctcatcctggcccccacccgcgtcgtggccgccgagatggaggaggccctgcgggggctccccatccgctaccagacccccgcggtgaagagcgagcacaccggccgggagatcgtcgacctgatgtgccacgccacgttcaccacccgcctgctctccagcacccgggtgccgaactacaacctgatcgtgatggacgaggcccacttcacggaccccagctccgtcgccgcccgcgggtacatcagcacccgggtggagatgggcgaggcggccgccatcttcatgaccgccaccccccccggggccacggacccgttcccccagtccaacagccccatcgaggacatcgagcgcgagatccccgagcgctcctggaacaccggcttcgactggatcaccgactaccagggcaagaccgtctggttcgtgccgagcatcaaggcggggaacgacatcgccaactgcctgcggaagtccggcaagaaggtgatccagctcagccgcaagacgttcgacaccgagtaccccaagaccaagctgaccgactgggacttcgtcgtgacgaccgacatctccgagatgggggccaacttccgggccggccgcgtgatcgacccccggcgctgcctgaagcccgtcatcctcaccgacgggccggagcgggtgatcctggcgggccccatccccgtgacccccgccagcgccgcccagcgccggggccgcatcgggcggaacccggcccaggaggacgaccagtacgtcttctccggcgaccccctgaagaacgacgaggaccacgcgcactggacggaggccaagatgctcctggacaacatctacacccccgaggggatcatccccaccctgttcggcccggagcgcgagaagacccaggccatcgacggcgagttccggctccgcggggagcagcggaagacgttcgtggagctgatgcgccggggcgacctgcccgtgtggctcagctacaaggtcgcctccgccgggatcagctacaaggaccgcgagtggtgcttcaccggcgagcggaacaaccagatcctggaggagaacatggaggtggagatctggacccgcgagggggagaagaagaagctgcggcccaagtggctcgacgcgcgcgtgtacgccgaccccatggccctgaaggacttcaaggagttcgcctccggccgcaagagcatcaccctggacatcctcaccgagatcgcctccctgccgacgtacctgagctcccgggcgaagctcgccctggacaacatcgtcatgctgcacaccaccgagcgcggcgggcgggcctaccagcacgccctcaacgagctgcccgagagcctggagaccctcatgctggtggcgctgctcggcgccatgacggccgggatcttcctgttcttcatgcagggcaaggggatcggcaagctgagcatgggcctcatcaccatcgccgtggcctccgggctgctgtgggtcgcggagatccagccccagtggatcgccgccagcatcatcctcgagttcttcctgatggtgctgctcatcccggagcccgagaagcagcgcaccccccaggacaaccagctgatctacgtgatcctgaccatcctcacgatcatcggcctgatcgccgccaacgagatggggctgatcgagaagaccaagaccgacttcggcttctaccaggtcaagaccgagacgaccatcctcgacgtggacctgcggcccgcgtccgcctggaccctgtacgccgtggccaccacgatcctcaccccgatgctgcgccacaccatcgagaacaccagcgccaacctgtccctcgcggccatcgccaaccaggccgccgtcctgatggggctgggcaagggctggcccctccaccggatggacctgggggtgcccctgctcgcgatgggctgctacagccaggtgaaccccacgaccctgaccgcctccctggtcatgctcctggtgcactacgccatcatcgggccgggcctgcaggccaaggcgacccgcgaggcccagaagcggacggccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcgcaccacgtgggcgttctgcgaggtcctgaccctcgccaccggcccgatcctgaccctgtgggaggggaaccccggccggttctggaacacgaccatcgccgtgtccaccgccaacatcttccgcggcagctacctcgccggggcgggcctggccttctccctgatcaagaacgcccagaccccccggcgcgggacgggcaccaccggggagaccctcggcgagaagtggaagcggcagctgaacagcctggaccgcaaggagttcgaggagtacaagcggtccggcatcctcgaggtggaccgcaccgaggccaagagcgccctgaaggacgggtccaagatcaagcacgcggtcagccggggctccagcaagatccgctggatcgtggagcgcgggatggtgaagcccaagggcaaggtcgtggacctggggtgcggccggggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccgcaccctgcgggtgctcaagatggtcgagccctggctgtccagcaagcccgagttctgcatcaaggtgctgaacccctacatgccgacggtgatcgaggagctggagaagctccagcgcaagcacgggggcaacctggtccggtgccccctgtcccgcaacagcacccacgagatgtactgggtgtccggcgccagcgggaacatcgtctccagcgtgaacaccacctccaagatgctcctgaaccggttcacgacccgccaccggaagcccacctacgagaaggacgtggacctgggcgcggggacccgcagcgtctccacggagaccgagaagcccgacatgaccatcatcggccggcgcctccagcggctgcaggaggagcacaaggagacctggcactacgaccaggagaacccgtaccgcacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgggtcttcaaggagaaggtggacacccgcacgccccagcccaagccgggcacccggatggtgatgaccaccacggcgaactggctgtgggccctcctggggaagaagaagaacccccgcctgtgcacccgggaggagttcatctccaaggtccgcagcaacgccgccatcggcgccgtgttccaggaggagcaggggtggaccagcgcgtccgaggccgtgagcgactcccggttctgggagctcgtcgacaaggagcgcgccctgcaccaggagggcaagtgcgagagctgcgtgtacaacatgatgggcaagcgcgagaagaagctgggggagttcggccgggccaaggggtcccgcgccatctggtacatgtggctcggcgcgcggttcctggagttcgaggccctggggttcctcaacgaggaccactggttcggccgcgagaacagctggtccggcgtggagggggagggcctgcaccggctggggtacatcctcgaggagatcgacaagaaggacggcgacctgatgtacgccgacgacaccgccggctgggacacgcgcatcaccgaggacgacctgcagaacgaggagctcatcaccgagcagatggcgccccaccacaagatcctggccaaggccatcttcaagctgacctaccagaacaaggtcgtgaaggtgctccggcccaccccgcgcggggccgtcatggacatcatcagccggaaggaccagcgcggctccgggcaggtgggcacgtacgggctgaacaccttcaccaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggcgatcagcggcgacgactgcgtcgtgaagcccctcgacgagcgcttcgggacgtccctgctgttcctcaacgacatgggcaaggtgcggaaggacatcccccagtgggagccgagcaaggggtggaagaactggcaggaggtccccttctgctcccaccacttccacaagatcttcatgaaggacggccgcagcctggtggtgccctgccggaaccaggacgagctgatcggccgcgcccgcatctcccagggggccggctggagcctccgggagaccgcctgcctggggaaggcctacgcgcagatgtggtccctgatgtacttccaccgccgggacctccgcctggccagcatggccatctgcagcgccgtccccaccgagtggttcccgacctcccggacgacctggagcatccacgcccaccaccagtggatgaccaccgaggacatgctgaaggtgtggaaccgcgtgtggatcgaggacaaccccaacatgatcgacaagacgcccgtccactcctgggaggacatcccctacctcggcaagcgggaggacctgtggtgcgggagcctgatcggcctctccagccgcgcgacctgggccaagaacatccacaccgccatcacccaggtgcggaacctgatcggcaaggaggagtacgtggactacatgccggtcatgaagcgctactccgcccccagcgagtccgagggggtgctgtga

SEQ ID NO: 10429 - RNA, 9867 nt, synthetic construct
  misc_feature 1..9867: note = derived and/or modified CDS sequence (opt1) from DENV-4__GQ868585__SS-prME
  source 1..9867: mol_type = other RNA
agcaccatcaccctgctctgcctgatccccaccgtgatggccttccacctgtccacccgcgacggcgagcccctcatgatcgtggccaagcacgagcgggggcgccccctgctgttcaagaccaccgagggcatcaacaagtgcacgctcatcgccatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacgagaaccacatgttcgcgggccacctcaagtgcaaggtgcgcatggagaagctgcgcatcaaggggatgtcctacacgatgtgcagcggcaagttctccatcgacaaggagatggccgagacccagcacggcaccaccgtcgtgaaggtgaagtacgagggggccggcgccccctgcaaggtccccatcgagatccgggacgtgaacaaggagaaggtggtcgggcgcgtgatcagcgccacgcccctggcggagaacaccaactccgtgaccaacatcgagctcgagccgcccttcggcgacagctacatcgtcatcggggtgggcaactccgccctgaccctgcactggttccggaagggcagctccatcgggaagatgttcgagagcacgtaccgcggcgccaagcggatggccatcctcggggagaccgcgtgggacttcggctccgtcggcgggctgttcaccagcctggggaaggccgtccaccaggtgttcgggtccgtgtacaccacgatgttcggcggggtcagctggatgatccgcatcctcatcggcttcctggtgctgtggatcgggaccaactcccggaacaccagcatggccatgacctgcatcgccgtgggcggcatcacgctgttcctcgggttcaccgtccaggccgacatgggctgcgtggtgtcctggagcgggcgcgagctgaagtgcggctccgggatcttcgtcgtggacaacgtgcacacctggaccgagcagtacaagttccagcccgagagccccgcgcggctggccagcgccatcctcaacgcccacaaggacggcgtctgcggcatccgctccacgacccggctggagaacgtgatgtggaagcagatcaccaacgagctgaactacgtgctctgggagggcgggcacgacctgaccgtcgtggccggggacgtgaagggcgtcctgacgaagggcaagcgcgcgctcaccccgcccgccagcgacctgaagtactcctggaagacctgggggaaggccaagatcttcacccccgaggcccggaacagcacgttcctgatcgacggccccgacacctccgagtgcccgaacgagcgccgggcctggaacagcttcgaggtggaggactacgggttcggcatgttcaccaccaacatctggatgaagttccgcgaggggtccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggcgtgctggagagccagatgctgatccccaagtcctacgccgggccgttcagccagcacaactaccggcagggctacgccacccagacggtcgggccctggcacctcggcaagctggagatcgacttcggggagtgccccggcaccaccgtgaccatccaggagaactgcgaccaccgcggcccctccctgcgcacgaccaccgccagcgggaagctcgtgacccagtggtgctgccggagctgcacgatgccgcccctgcgcttcctgggcgaggacgggtgctggtacggcatggagatccggcccctctccgagaaggaggagaacatggtcaagagccaggtgaccgccgggcagggcacctccgagaccttcagcatgggcctgctgtgcctcacgctgttcgtcgaggagtgcctgcgccggcgcgtgacccggaagcacatgatcctcgcggtggtcatcaccctgtgcgccatcatcctcgggggcctcacctggatggacctgctgcgcgccctcatcatgctgggggacacgatgtccggccggatcggcgggcagacccacctggccatcatggccgtgttcaagatgagccccggctacgtgctcggggtcttcctgcgcaagctgacctcccgggagaccgcgctcatggtgatcggcatggccatgacgaccaccctgagcatcccgcacgacctgatggagctcatcgacgggatctccctgggcctgatcctcctgaagatcgtgacccagttcgacaacacgcaggtcggcaccctggccctcagcctgaccttcatccgctccaccatgagcctggtgatggcctggcggacgatcatggccgtgctgttcgtcgtgaccctgatccccctgtgccgcacctcctgcctccagaagcagagccactgggtggagatcaccgcgctgatcctgggggcccaggccctccccgtctacctgatgacgctgatgaagggcgcctcccggcgcagctggcccctcaacgaggggatcatggcggtgggcctggtgtccctgctcgggagcgccctgctgaagaacgacgtcccgctcgccggccccatggtggccggcgggctgctgctcgccgcgtacgtgatgtccggcagcagcgccgacctgtccctggagaaggccgccaacgtccagtgggacgagatggccgacatcaccgggagctcccccatcatcgaggtgaagcaggacgaggacggcagcttctccatccgggacgtggaggagaccaacatgatcaccctcctggtcaagctggcgctcatcacggtgagcgggctgtaccccctggccatcccgatcaccatgaccctctggtacatgtggcaggtcaagacccagcgctccggcgccctgtgggacgtccccagccccgccgccacccagaaggcggccctgtccgagggcgtgtaccggatcatgcagcgcggcctcttcggcaagacccaggtgggggtcggcatccacatggagggggtgttccacaccatgtggcacgtgacccggggcagcgtcatctgccacgagaccggccgcctggagccctcctgggccgacgtgcgcaacgacatgatcagctacgggggcgggtggcggctgggcgacaagtgggacaaggaggaggacgtgcaggtcctcgccatcgagccgggcaagaaccccaagcacgtgcagacgaagcccgggctgttcaagaccctgaccggcgagatcggggccgtgaccctcgacttcaagcccggcacgtccgggagcccgatcatcaaccgcaagggcaaggtcatcggcctgtacgggaacggcgtggtgaccaagtccggggactacgtcagcgcgatcacccaggccgagcggatcggcgagcccgactacgaggtggacgaggacatcttccgcaagaagcggctgaccatcatggacctccaccccggggccggcaagacgaagcgcatcctgccgtccatcgtgcgggaggccctgaagcgccggctgcgcaccctcatcctggcgcccacccgggtcgtggccgccgagatggaggaggccctgcgcggcctccccatccggtaccagacccccgccgtcaagagcgagcacacggggcgcgagatcgtcgacctgatgtgccacgcgaccttcaccacccggctgctctccagcacgcgcgtgccgaactacaacctgatcgtgatggacgaggcccacttcaccgaccccagctccgtcgccgcccggggctacatcagcacccgcgtggagatgggggaggccgcggccatcttcatgaccgccacgccgcccggcgccaccgacccgttcccccagtccaacagccccatcgaggacatcgagcgggagatccccgagcgctcctggaacaccgggttcgactggatcaccgactaccagggcaagacggtctggttcgtgccgagcatcaaggccggcaacgacatcgcgaactgcctgcgcaagtccgggaagaaggtgatccagctcagccggaagaccttcgacaccgagtaccccaagaccaagctgacggactgggacttcgtcgtgaccaccgacatctccgagatgggcgccaacttccgcgccgggcgggtgatcgacccccgccggtgcctgaagcccgtcatcctcaccgacggcccggagcgcgtgatcctggccgggcccatccccgtgacgcccgcgagcgccgcccagcggcgcggccggatcggccgcaacccggcccaggaggacgaccagtacgtcttctccggggaccccctgaagaacgacgaggaccacgcccactggaccgaggcgaagatgctcctggacaacatctacacccccgagggcatcatccccaccctgttcgggccggagcgggagaagacgcaggccatcgacggcgagttccgcctccggggcgagcagcgcaagaccttcgtggagctgatgcggcgcggggacctgcccgtgtggctcagctacaaggtcgcctccgccggcatcagctacaaggaccgggagtggtgcttcaccggggagcgcaacaaccagatcctggaggagaacatggaggtggagatctggacccgggagggcgagaagaagaagctgcgccccaagtggctcgacgcccgggtgtacgcggaccccatggccctgaaggacttcaaggagttcgcctccgggcgcaagagcatcaccctggacatcctcacggagatcgcctccctgccgacctacctgagctcccgcgccaagctcgcgctggacaacatcgtcatgctgcacaccaccgagcggggcggccgcgcctaccagcacgccctcaacgagctgcccgagagcctggagacgctcatgctggtggccctgctcggggcgatgaccgccggcatcttcctgttcttcatgcaggggaagggcatcgggaagctgagcatgggcctcatcaccatcgccgtggcctccggcctgctgtgggtcgccgagatccagccccagtggatcgcggccagcatcatcctcgagttcttcctgatggtgctgctcatcccggagcccgagaagcagcggacgccccaggacaaccagctgatctacgtgatcctgacgatcctcaccatcatcgggctgatcgccgccaacgagatgggcctgatcgagaagaccaagaccgacttcgggttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatgggcctggggaagggctggcccctccaccgcatggacctgggcgtgcccctgctcgccatggggtgctacagccaggtgaaccccaccaccctgaccgcgtccctggtcatgctcctggtgcactacgccatcatcggcccggggctgcaggccaaggccacgcgggaggcgcagaagcgcaccgccgccggcatcatgaagaaccccaccgtggacggcatcaccgtcatcgacctcgagcccatcagctacgaccccaagttcgagaagcagctgggccaggtgatgctgctcgtgctgtgcgccggccagctgctcctgatgcggacgacctgggccttctgcgaggtcctgaccctcgcgaccgggccgatcctgacgctgtgggagggcaaccccgggcgcttctggaacaccaccatcgccgtgtccaccgccaacatcttccggggcagctacctcgccggcgccgggctggcgttctccctgatcaagaacgcccagacgccccgccggggcaccgggaccaccggcgagaccctcggggagaagtggaagcgccagctgaacagcctggaccggaaggagttcgaggagtacaagcgctccggcatcctcgaggtggaccggacggaggccaagagcgccctgaaggacggctccaagatcaagcacgccgtcagccgcgggtccagcaagatccggtggatcgtggagcgcggcatggtgaagcccaaggggaaggtcatcgacctgggctgcgggcgcggcggctggtcctactacatggcgaccctcaagaacgtgaccgaggtgaaggggtacaccaagggcgggccgggccacgaggagcccatccccatggccacgtacgggtggaacctggtcaagctgcacagcggcgtggacgtgttctacaagcccaccgagcaggtcgacaccctcctgtgcgacatcggcgagagctccagcaacccgaccatcgaggaggggcggacgctgcgcgtgctcaagatggtggagccctggctgtccagcaagcccgagttctgcatcaaggtcctgaacccctacatgccgaccgtgatcgaggagctggagaagctccagcggaagcacggcgggaacctggtgcgctgccccctgtcccggaacagcacccacgagatgtactgggtctccggcgccagcggcaacatcgtgtccagcgtcaacaccacgtccaagatgctcctgaaccgcttcaccacccggcaccgcaagcccacctacgagaaggacgtggacctgggggccggcacgcggagcgtgtccaccgagaccgagaagcccgacatgaccatcatcgggcgccggctccagcgcctgcaggaggagcacaaggagacgtggcactacgaccaggagaacccgtaccggacctgggcgtaccacggcagctacgaggccccctccaccgggagcgcctccagcatggtcaacggcgtggtgaagctgctcaccaagccctgggacgtcatcccgatggtgacgcagctggccatgaccgacaccacccccttcggccagcagcgcgtgttcaaggagaaggtcgacacgcggacgccccagcccaagccggggacccgcatggtgatgaccacgaccgccaactggctgtgggcgctcctgggcaagaagaagaacccccggctgtgcacccgcgaggagttcatctccaaggtgcggagcaacgccgccatcggggccgtcttccaggaggagcagggctggaccagcgcctccgaggcggtgaacgacagccgcttctgggagctcgtggacaaggagcgggccctgcaccaggaggggaagtgcgagtcctgcgtctacaacatgatgggcaagcgcgagaagaagctgggcgagttcgggcgcgccaagggcagccgggccatctggtacatgtggctcggggcccgcttcctggagttcgaggcgctgggcttcctcaacgaggaccactggttcgggcgggagaactcctggagcggcgtggagggcgaggggctgcaccgcctgggctacatcctcgaggagatcgacaagaaggacggggacctgatgtacgccgacgacacggccggctgggacacccggatcaccgaggacgacctgcagaacgaggagctcatcaccgagcagatggcgccccaccacaagatcctggcgaaggccatcttcaagctgacctaccagaacaaggtggtcaaggtgctccgccccacgccgcggggcgccgtgatggacatcatctcccgcaaggaccagcgggggagcggccaggtcgggacctacggcctgaacaccttcaccaacatggaggtgcagctgatccgccagatggaggccgagggggtgatcacgcaggacgacatgcagaaccccaagggcctcaaggagcgggtcgagaagtggctgcgcgagtgcggcgtggaccggctgaagcgcatggccatctccggggacgactgcgtggtcaagcccctcgacgagcggttcggcaccagcctgctgttcctcaacgacatggggaaggtgcgcaaggacatcccccagtgggagccgtccaagggctggaagaactggcaggaggtgcccttctgcagccaccacttccacaagatcttcatgaaggacgggcggtccctggtcgtgccctgccgcaaccaggacgagctgatcggccgggcgcgcatcagccagggcgccgggtggtccctccgcgagaccgcctgcctgggcaaggcctacgcccagatgtggagcctgatgtacttccaccggcgcgacctccggctggcgtccatggccatctgcagcgccgtgcccaccgagtggttcccgacgagccgcaccacctggtccatccacgcccaccaccagtggatgaccacggaggacatgctgaaggtctggaaccgggtgtggatcgaggacaaccccaacatgatcgacaagacccccgtgcacagctgggaggacatcccctacctcgggaagcgcgaggacctgtggtgcggctccctgatcgggctcagctcccgggccacctgggcgaagaacatccacaccgccatcacgcaggtccgcaacctgatcggcaaggaggagtacgtggactacatgccggtgatgaagcggtacagcgccccctccgagagcgagggcgtcctgtga

SEQ ID NO: 10430 - RNA, 9867 nt, synthetic construct
  misc_feature 1..9867: note = derived and/or modified CDS sequence (opt1) from DENV-4__JQ922560__SS-prME
  source 1..9867: mol_type = other RNA
agcaccatcaccctgctctgcctgatccccaccgtgatggccttccacctgtccacccgggacggggagccgctcatgatcgtggccaagcacgagcgggggcgccggctgctgttcaagaccaccgaggggatcaacaagtgcaccctcatcgccatggacctgggggagatgtgcgaggacaccgtgacctacaagtgccccctgctcgtgaacaccgagcccgaggacatcgactgctggtgcaacctgaccagcgcctgggtgatgtacgggacctgcacccagtccggggagcgccggcgcgagaagcggagcgtggccctgacgccccactccggcatgggcctcgagacccgcgccgagacctggatgagctccgagggggcctggaagcacgcccagcgggtggagagctggatcctgcgcaacccgggcttcgccctgctcgccgggttcatggcctacatgatcggccagaccgggatccagcggaccgtgttcttcatcctgatgatgctggtggcgccctcctacggcatgcgctgcgtgggcgtggggaaccgggacttcgtggagggcgtgagcgggggcgcctgggtcgacctcgtgctggagcacggcgggtgcgtgaccaccatggcccagggcaagcccaccctggacttcgagctcatcaagaccacggccaaggaggtcgccctgctgcgcacctactgcatcgaggcgtccatcagcaacatcaccaccgccacgcggtgccccacccagggggagccgtacctcaaggaggagcaggaccagcagtacatctgccgccgggacgtggtggaccgcggctgggggaacggctgcggcctgttcgggaagggcggggtcgtgacctgcgccaagttctcctgcaccggcaagatcacggggaacctgatccagatcgagaacctcgagtacaccgtggtcgtgaccgtgcacaacggcgacacccacgccgtcggcaacgacacgagcaaccacggggtgaccgccaccatcacgccccggtcccccagcgtcgaggtggagctgcccgactacggcgagctgacgctcgactgcgagccgcgctccgggatcgacttcaacgagatgatcctgatgaagatgaacaagaagacctggctggtgcacaagcagtggttcctcgacctgcccctgccctgggcggccggcgccgacaccagcgaggtccactggaaccacaaggagcggatggtgaccttcaaggtgccccacgccaagcgccaggacgtcaccgtgctcgggtcccaggagggcgccatgcacagcgcgctgacgggcgccaccgaggtgtacagcggggacggcaacctgatgttcgccgggcacctcaagtgcaaggtccgcatggagaagctgcggatcaagggcatgtcctacaccatgtgcagcggcaagttctccatcgacaaggagatggccgagacccagcacgggacgaccgtggtgaaggtcaagtacgagggcgccggggcgccgtgcaaggtgcccatcgagatccgcgacgtgaacaaggagaaggtcgtgggccgggtgatcagctccacccccttcgccgagaacaccaacagcgtcacgaacatcgagctggagcccccgttcggggactcctacatcgtgatcggcgtgggcgacagcgccctcaccctgcactggttcaccaaggggtccagcatcggcaagatgttcgagtccacctaccgcggggccaagcggatggcgatcctgggcgagacggcctgggacttcgggagcgtcggcggcctcctgacctccctggggaaggccgtgcaccaggtgttcggcagcgtctacaccaccatgttcgggggcgtgtcctggatggtgcgcatcctcatcgggttcctggtcctgtggatcggcacgaacagccggaacacctccatggccatgagctgcatcgccgtgggcgggatcaccctgttcctcggcttcaccgtgcacgcggacatggggtgcgccgtctcctggagcggcaaggagctgaagtgcgggagcggcatcttcatcatcgacaacgtgcacacgtggaccgagcagtacaagttccagcccgagtcccccgcccgcctggccagcgccatcctcaacgcgcacaaggacggcgtgtgcgggatccggtccaccacccgcctggagaacgtcatgtggaagcagatcacgaacgagctgaactacgtgctctgggagggcgggcacgacctgaccgtggtcgccggcgacgtgaagggcgtgctgagcaaggggaagcgggccctcgcgccgcccgtcaacgacctgaagtactcctggaagacctggggcaaggccaagatcttcacccccgagacgcgcaacagcaccttcctgatcgacgggcccgacacctccgagtgccccaacgagcggcgcgcgtggaacttcctcgaggtggaggactacggcttcgggatgttcaccacgaacatctggatgaagttccgggagggcagctccgagatgtgcgaccaccgcctgatgagcgccgccatcaaggaccagaaggccgtgcacgcggacatgggctactggatcgagtccagcaagaaccagacctggcagatcgagaaggcctccctgatcgaggtcaagacctgcctctggcccaagacccacacgctgtggagcaacggggtgctggagtcccagatgctcatccccaaggcctacgccggccccttcagccagcacaactaccggcaggggtacgccacccagaccgtgggcccgtggcacctggggaagctggagatcgacttcggcgagtgccccggcaccaccgtcacgatccaggaggactgcgaccaccgcgggccctccctccggaccaccaccgcgagcggcaagctggtgacgcagtggtgctgccgcagctgcaccatgcccccgctgcgcttcctcggggaggacggctgctggtacgggatggagatccggcccctgtccgagaaggaggagaacatggtcaagagccaggtctccgccggccagggcaccagcgagaccttctccatggggctgctctgcctgacgctgttcgtggaggagtgcctccgccggcgcgtgacccggaagcacatgatcctggtcgtggtcaccaccctgtgcgccatcatcctcggcgggctgacgtggatggacctgctccgcgccctgatcatgctgggcaacaccatgagctcccggatgggcgggcagatccacctcgccatcatggcggtgttcaagatgagccccggctacgtgctggggatcttcctgcgcaagctcacctcccgggagaccgccctgatggtcatcggcatggccatgacgaccgtgctgagcatcccccacgacctcatggagttcgtggacgggatctccctgggcctgatcctcctgaagatggtcacccacttcgacaacacccaggtgggcacgctggccctcagcctgaccttcatcaagtccaccatgccgctggtgatggcctggcgcaccatcatggcggtcctcttcgtggtgacgctgatccccctgtgccggaccagctgcctccagaagcagtcccactgggtcgagatcaccgccctgatcctgggggcccaggccctccccgtgtacctgatgaccctgatgaagggcgcgagcaagcgctcctggcccctcaacgaggggatcatggccgtgggcctggtcagcctgctcgggtccgccctgctgaagaacgacgtgccgctcgccggccccatggtggccggcgggctgctgctcgcggcctacgtcatgagcggcagctccgccgacctgagcctggagaaggccgccacggtgcagtgggacgagatggcggacatcaccgggtccagccccatcatcgaggtgaagcaggacgaggacggctccttcagcatccgggacgtcgaggagaccaacatgatcaccctcctggtgaagctggccctcatcacggtgtccgggctgtaccccctggccatcccggtcaccatgaccctctggtacatgtggcaggtcaagacccagcgcagcggcgccctgtgggacgtgccctcccccgccgcggcccagaaggccacgctgaccgagggcgtctaccggatcatgcagcgcggcctcttcggcaagacccaggtgggggtgggcatccacatggagggggtcttccacaccatgtggcacgtgacccggggcagcgtgatctgccacgagtccggccgcctggagcccagctgggccgacgtccggaacgacatgatctcctacgggggcgggtggcgcctgggcgacaagtgggacaaggaggaggacgtccaggtgctcgccgtcgagccgggcaagaaccccaagcacgtgcagacgaagcccgggctgttcaagaccctgaccggcgagatcggggcggtgaccctcgacttcaagcccggcacgagcgggtccccgatcatcaaccggaagggcaaggtcatcggcctgtacgggaacggcgtggtgaccaagagcggggactacgtctccgccatcacccaggccgagcgcatcggcgagcccgactacgaggtggacgaggacatcttccgcaagaagcggctgaccatcatggacctccaccccggggccggcaagacgaagcgcatcctgccgagcatcgtgcgggaggcgctgaagcgccggctgcgcaccctcatcctggcccccacccgggtcgtggccgccgagatggaggaggccctgcgcggcctccccatccggtaccagacccccgcggtgaagtccgagcacacggggcgcgagatcgtcgacctgatgtgccacgccaccttcaccacccggctgctcagcagcacgcgcgtgccgaactacaacctgatcgtgatggacgaggcccacttcaccgacccctccagcgtcgccgcccggggctacatctccacccgcgtggagatgggggaggcggccgccatcttcatgaccgccacgccgcccggcaccaccgacccgttcccccagagcaactcccccatcgaggacatcgagcgggagatccccgagcgcagctggaacaccgggttcgactggatcacggactaccagggcaagaccgtctggttcgtgccgtccatcaaggccggcaacgacatcgcgaactgcctgcgcaagagcgggaagaaggtggtccagctctcccgcaagaccttcgacaccgagtaccccaagacgaagctgaccgactgggacttcgtggtgaccaccgacatcagcgagatgggcgccaacttccgggccgggcgcgtcatcgacccccgccggtgcctgaagcccgtgatcatcacggacggcccggagcgcgtgatcctcgccgggcccatccccgtcacccccgcgtccgccgcccagcggcgcggccggatcggccgcaacccggcccaggaggacgaccagtacgtgttcagcggggaccccctgcggaacgacgaggaccacgcccactggaccgaggcgaagatgctgctcgacaacatctacacccccgagggcatcatccccacgctgttcgggccggagcgcgagaagacccaggccatcgacggcgagttccggctgcgcggcgagcagcggaagaccttcgtggagctcatgcgccgcggggacctgcccgtctggctgtcctacaaggtggccagcgccggcatctcctacaaggaccgcgagtggtgcttcaccggggagcggaacaaccagatcctcgaggagaacatggaggtggagatctggacgcgcgagggcgagaagaagaagctgcggcccaagtggctggacgcccgcgtctacgcggaccccgtggccctcaaggacttcaaggagttcgccagcgggcggaagtccatcaccctggacatcctgaccgagatcgccagcctcccgacctacctgtccagccgcgccaagctggcgctcgacaacatcgtgatgctgcacaccacggagcggggcggcaaggcctaccagcacgccctgaacgagctccccgagagcctggagaccctgatgctcatcgccctgctgggggcgatgaccgccggcatcttcctcttcttcatgcaggggaagggcatggggaagctgtccatgggcctgatcgccatcgccgtcgccagcggcctcctgtgggtggcggagatccagccccagtggatcgccgcctccatcatcctggagttcttcctcatggccctgctgatcccggagcccgagaagcagcgcacgccccaggacaaccagctcatctacgtgatcctgacgatcctgaccatcatcgggctcgtcgccgcgaacgagatgggcctgatcgagaagaccaagaccgacttcgggttctaccaggagaagacggagaccaccatcctggacgtggacctccgccccgccagcgcctggaccctgtacgccgtggccacgaccatcctgaccccgatgctccggcacaccatcgagaacacgtccgcgaacctgagcctggccgccatcgccaaccaggccgcggtcctcatgggcctggggaagggctggcccctgcaccgcatggacctcggcgtgcccctgctggccatggggtgctactcccaggtgaaccccaccaccctcaccgccagcctggtcatgctgctcgtgcactacgccatcatcggcccggggctgcaggcgaaggccacgcgggaggcccagaagcgcaccgccgccggcatcatgaagaaccccaccgtggacggcatcaccgtcatcgacctggagcccatctcctacgaccccaagttcgagaagcagctcggccaggtgatgctgctggtgctctgcgcgggccagctgctgctcatgcggacgacctgggccttctgcgaggtcctgaccctggccaccgggccgatcctcacgctgtgggagggcaaccccgggcgcttctggaacaccaccatcgccgtgagcaccgccaacatcttccggggctcctacctggcgggcgccgggctcgccttcagcctgatcaagaacacgcagacgccccggcggggcaccgggaccacgggcgagaccctgggggagaagtggaagcgccagctcaactccctggaccggaaggagttcgaggagtacaagcgcagcggcatcctggaggtggaccggaccgaggccaagtccgccctcaaggacggcagcaagatcaagtacgcggtctcccgcgggaccagcaagatccggtggatcgtggagcgcggcatggtgaagcccaaggggaaggtcgtggacctgggctgcgggcggggcggctggtcctactacatggccaccctgaagaacgtgacggaggtcaaggggtacaccaagggcgggccgggccacgaggagcccatccccatggccacctacgggtggaacctcgtgaagctgcacagcggcgtggacgtcttctacaagcccaccgagcaggtcgacacgctgctctgcgacatcggcgagagctccagcaacccgaccatcgaggaggggcgcaccctgcgggtgctgaagatggtcgagccctggctctccagcaagcccgagttctgcatcaaggtgctgaacccctacatgccgaccgtgatcgaggagctggagaagctgcagcgcaagcacggcgggtccctcgtccgctgccccctgagccggaactccacgcacgagatgtactgggtgagcggcgtctcccgcaacatcgtgagctccgtgaacaccaccagcaagatgctgctcaaccggttcaccacgcgctaccggaagcccacctacgagaaggacgccgacctgggcgcggggacccgctccgtcagcaccgagacggagaagcccgacatggccatcatcggccggcgcctgcagcggctccaggaggagcacaaggagacctggcactacgaccaggagaacccgtaccgcacctgggcctaccacgggtcctacgaggcccccagcaccggctccgccagctccatggtgaacggggtggtcaagctgctgacgaagccctgggacgtggtgccgatggtcacccagctcgcgatgaccgacaccacgcccttcggccagcagcgggtgttcaaggagaaggtggacacccgcacgccccagcccaagccgggcacccggatgatcatgacgaccaccgccaactggctgtgggccctgctcgggaagaagaagaacccccgcctgtgcacccgggaggagttcatcagcaaggtccgcagcaacgccgccatcggcgcggtgtcccaggaggagcaggggtggacgagcgcctccgaggccgtgaacgacagccggttctgggagctggtcgacaaggagcgcgccctccaccaggagggcaagtgcgagtcctgcgtgtacaacatgatggggaagcgggagaagaagctgggcgagttcggccgcgccaaggggagccgggcgatctggtacatgtggctgggcgcccgcttcctcgagttcgaggccctggggttcctgaacgaggaccactggttcggccgcgagaactcctggagcggggtggagggcgagggcctccaccggctggggtacatcctggaggacatcgacaagaaggacggcgacctcatctacgccgacgacaccgcggggtgggacacccgcatcaccgaggacgacctgctgaacgaggagctcatcacggagcagatggcgccccaccacaagatcctggccaaggccatcttcaagctgacctaccagaacaaggtcgtgaaggtgctccggcccaccccgaagggcgccgtcatggacatcatctcccgcaaggaccagcggggcagcggccaggtgggcacctacgggctgaacaccttcacgaacatggaggtgcagctgatccgccagatggaggcggagggcgtcatcacccgggacgacatgcacaaccccaaggggctcaaggagcgcgtggagaagtggctgaaggagtgcggcgtggaccggctgaagcgcatggccatctccggcgacgactgcgtcgtgaagcccctcgacgagcggttcagcacctccctgctgttcctcaacgacatggggaaggtgcgcaaggacatcccccagtgggagccgagcaagggctggaagaactggcaggaggtccccttctgctcccaccacttccacaagatcttcatgaaggacgggcggagcctggtggtgccctgccgcaaccaggacgagctgatcggccgggcccgcatctcccagggggccggctggagcctccgggagaccgcctgcctgggcaaggcgtacgcccagatgtggagcctgatgtacttccaccgccgggacctccgcctggcctccatggccatctgcagcgccgtccccacggagtggttcccgacctcccgcaccacctggagcatccacgcgcaccaccagtggatgacgaccgaggacatgctgaaggtgtggaaccgggtgtggatcgaggacaaccccaacatgaccgacaagacccccgtccactcctgggaggacatcccctacctcgggaagcgcgaggacctgtggtgcggcagcctgatcgggctctccagccgggccacgtgggccaagaacatccacaccgccatcacccaggtgcgcaacctgatcggcatcgaggagtacgtggactacatgccggtcatgaagcggtactccgcccccttcgagagcgagggggtgctgtga

SEQ ID NO: 10431 - RNA, 9867 nt, synthetic construct
  misc_feature 1..9867: note = derived and/or modified CDS sequence (opt1) from DENV-4__JQ922558__SS-prME
  source 1..9867: mol_type = other RNA
agcaccctgaccctcctgtgcctgatccccacggtgatggccttccacctctccacccgcgacggcgagccgctgatgatcgtggccaagcacgagcgggggcgccccctgctgttcaagaccaccgagggcatcaacaagtgcacgctgatcgcgatggacctgggggagatgtgcgaggacaccgtgacctacaagtgccccctcctggtgaacaccgagcccgaggacatcgactgctggtgcaacctgacgagcacctgggtgatgtacgggacctgcacccagtccggggagcggcgccgggagaagcgcagcgtggccctcacgccgcactccggcatgggcctggagacccgggccgagacctggatgagctccgagggggcctggaagcacgcccagcgcgtggagagctggatcctgcggaaccccggcttcgcgctcctggccgggttcatggcctacatgatcggccagaccgggatccagcgcacggtgttcttcgtgctgatgatgctcgtggccccctcctacggcatgcggtgcgtgggcgtggggaaccgcgacttcgtggagggcgtgagcgggggcgcgtgggtggacctggtgctggagcacggcgggtgcgtcaccaccatggcccagggcaagcccaccctcgacttcgagctgatcaagacgaccgccaaggaggtggccctgctccggacctactgcatcgaggcctccatcagcaacatcaccacggcgacccgctgccccacccagggggagccctacctgaaggaggagcaggaccagcagtacatctgccggcgcgacgtggtcgaccggggctgggggaacggctgcggcctgttcgggaagggcggggtggtgacctgcgccaagttcctctgcctgggcaagatcacggggaacctggtccagatcgagaacctcgagtacaccgtggtggtcaccgtgcacaacggcgacacccacgccgtcggcaacgacatctccaaccacggggtgacggccaccatcacgccccggagcccctccgtggaggtcaagctgccggactacggcgagctgaccctcgactgcgagccccggagcgggatcgacttcaacgagatgatcctgatgaagatgaagaagaagacgtggctggtgcacaagcagtgggtgctcgacctgcccctgccctgggccgcgggcgccgacacctccaaggtccagtggaactacaaggagcgcatggtgaccttcaaggtgccgcacgccaagcggcaggacgtcaccgtgctcgggagccaggagggcgccatgcactccgccctgaccggcgcgacggaggtggacagcggggacggcaaccacatgttcgccgggcacctgaagtgcaaggtccgcatggagaagctccgcatcaagggcatgagctacaccatgtgctccggcaagttcagcatcgacaaggagatggccgagacccagcacgggaccacggtggtgaaggtcaagtacgagggcgccggggccccctgcaaggtgcccatcgagatccgggacgtgaacaaggagaaggtcgtgggccgcatcatctccagcacccccttcgcggagcacaccaactccgtgaccaacatcgagctggagccgcccttcggggacagctacatcgtcatcggcgtgggcgactccgccctgacgctccactggttccggaaggggagctccatcggcaagatgttcgagagcacctaccgcggggccaagcggatggccatcctgggcgagaccgcgtgggacttcgggtccgtgggcggcctgttcaccagcctcgggaaggccgtccaccaggtgttcggctccgtgtacacgaccatgttcgggggcgtcagctggatggtgcgcatcctgatcgggctgctggtgctctggatcggcaccaactcccggaacaccagcatggccatgacgtgcatcgccatcggcgggatcaccctgttcctgggcttcaccgtccacgccgacatggggtgcgcggtgtcctggagcggcaaggagctcaagtgcgggtccggcatcttcgtggtcgacaacgtgcacacctggacggagcagtacaagttccagcccgagagccccgcccgcctggccagcgccatcctgaacgcccacaaggacggcgtgtgcgggatccggtccaccacccgcctcgagaacgtcatgtggaagcagatcaccaacgagctgaactacgtgctgtgggagggcgggcacgacctcacggtggtcgcgggcgacgtgaagggcgtgctgaccaaggggaagcgggccctgaccccgcccgtcaacgacctcaagtacagctggaagacctggggcaaggccaagatcttcacgcccgaggcccgcaactccaccttcctgatcgacgggcccgacaccagcgagtgcccgaacgagcggcgcgcctggaacttcctggaggtggaggactacggcttcgggatgttcaccacgaacatctggatgaagttccgggagggctccagcgaggtgtgcgaccaccgcctcatgtccgcggccatcaaggaccagaaggccgtccacgccgacatgggctactggatcgagagctccaagaaccagccctggcagatcgggaacgcgagcctgatcgaggtgaagacctgcctgtggcccaagacccacaccctctggtccaacggcgtgctggagagccagatgctgatcccgaaggcctacgccgggcccttctcccagcacaactaccggcagggctacgccacgcagaccatcgggccctggcacctcggcaagctggagatcgacttcggcgagtgccccgggaccaccgtcaccatccaggaggactgcaaccaccgcggcccgagcctgcggacgaccaccgcctccgggaagctcgtgacccagtggtgctgccgcagctgcacgatgccgcccctgcgcttcctgggcgaggacgggtgctggtacggcatggagatccggcccctctccgagaaggaggagaacatggtcaagagccaggtcagcgcgggccaggggacctccgagaccttcagcatgggcctgctgtgcctcaccctgttcgtggaggagtgcctgcgccggcgcgtcacgcggaagcacatgatcctcgtggtggtcaccaccctgtgcgccatcatcctcggcggcctcacctggatggacctgctgcgcgccctcatcatgctgggcgacacgatgtccgggcggatgggcgggcagatccacctgaccatcatggccgtgttcaagatgagcccgggctacgtgctcggggtcttcctgcgcaagctgacctcccgggagaccgccctcatcgtgatcggcatggcgatgacgaccgtgctgagcatcccccacgacctgatggagttcatcgacggcatctccctcgggctgatcctgctcaagatggtcgcccacttcgacaacacccaggtgggcaccctggccctgagcctcacgttcatccgctccaccatgcccctggtgatggcctggcggaccatcatggccgtcctgttcgtggtgaccctcatccccctgtgccgcacgagctgcctgcagaagcagtcccactgggtcgagatcaccgcgctcatcctgggggcccaggccctgccggtgtacctcatgaccctgatgaagggcgccagcaagcggtcctggcccctgaacgaggggatcatggcggtgggcctcgtcagcctgctgggctccgccctcctgaagaacgacgtgcccctggccgggcccatggtggccggcgggctcctgctggccgcgtacgtcatgagcggctccagcgccgacctctccctggagaaggccgccaacgtgcactgggacgagatggccgacatcaccgggagcagcccgatcatcgaggtgaagcaggacgaggacggctccttcagcatccgcgacgtcgaggagacgaacatgatcaccctgctcgtgaagctggcgctgatcaccgtgtccggcctctaccccctggccatccccgtcaccatgacgctgtggtacatgtggcaggtcaagacccagcggagcggggccctctgggacgtgccctccccggccgccgcgcagaaggccaccctgaccgagggcgtctaccgcatcatgcagcgggggctgttcggcaagacccaggtgggggtgggcatccacatggagggcgtcttccacaccatgtggcacgtgacccgcgggagcgtgatctgccacgagaccggccggctcgagccctcctgggccgacgtccgcaacgacatgatcagctacgggggcggctggcggctgggggacaagtgggacaaggaggaggacgtccaggtgctggccatcgagcccggcaagaaccccaagcacgtccagaccaagccggggctgttcaagacgctgaccggcgagatcggggccgtgaccctggacttcaagcccggcacctccggcagccccatcatcaacaagaaggggaaggtgatcggcctctacgggaacggcgtcgtgacgaagtccggggactacgtgagcgcgatcacccaggccgagcgcatcggcgacccggactacgaggtcgacgaggacatcttccgcaagaagcggctgaccatcatggacctgcaccccggcgccgggaagaccaagcgcatcctgccctccatcgtgcgggaggccctcaagcgccggctgcgcacgctgatcctcgcgcccacccgggtggtcgccgccgagatggaggaggccctgcgcggcctgccgatccggtaccagacccccgccgtcaagagcgagcacaccgggcgcgagatcgtggacctcatgtgccacgcgacgttcaccgccaaccccctgtccagcacccgggtccccaactacaacctgatcgtgatggacgaggcccacctccaggacctgtccatcgtcgccgcccgcggctacatcagcacccgggtggagatgggggaggcggccgccatcttcatgacggccaccccgcccggcgccaccgaccccttcccccagtccaacagcccgatcgaggacatcgagcgcgagatccccgagcggagctggaacaccggcttcgactggatcacggactaccaggggaagaccgtgtggttcgtcccctccatcaaggcgggcaacgacatcgccaactgcctgcgcaagagcgggaagaaggtgatccagctctcccggaagaccttcgacaccgagtaccccaagacgaagctgaccgactgggacttcgtggtcaccaccgacatcagcgagatgggcgccaacttccgcgcccggcgcgtgatcgacccgcgccggtgcctgaagcccgtgatcctcacggacgggcccgagcgcgtcatcctggcgggccccatcccggtgacccccgcctccgccgcccagcggcgcggccggatcgggcgcaaccccgcccaggaggacgaccagtacgtgttcagcggcgaccccctgaagaacgacgaggaccacgcgcactggaccgaggccaagatgctcctggacaacatctacaccccggaggggatcatccccacgctgttcggccccgagcgggagaagatccaggccatcgacggcgagttccgcctccgcggggagcagcgcaagaccttcgtcgagctgatgcggcgcggcgacctgcccgtgtggctctcctacaaggtggccagcgccgggatctcctacaaggaccgggagtggtgcttcaccggcgagcgcaacaaccagatcctggaggagaacatggaggtcgagatctggacccgggagggggagaagaagaagctgcgcccgaagtggctcgacgcgcgggtgtacgccgaccccatggccctgaaggacttcaaggagttcgccagcggccgcaagtccatcacgctggacatcctcaccgagatcgccagcctgcccacctacctgtccagccgggcgaagctcgccctggacaacatcgtgatgctgcacaccacggagcgcggcgggcgggcctaccagcacgccctcaacgagctgccggagtccctggagaccctcatgctggtcgcgctgctcggcgccatgaccgccgggatcttcctgttcttcatgcagggcaaggggatcggcaagctgagcatgggcctcatggccatcgccgtggcgtccgggctgctgtgggtggccgagatccagccccagtggatcgccgccagcatcatcctcgagttcttctccatggccctgctgatccccgagcccgagaagcagcgcaccccgcaggacaaccagctcatctacgtcatcctgaccatcctgacgatcatcggcctcatcgcggccaacgagatggggctgatcgagaagaccaagaccgacttcggcttctaccaggtgaagaccgagacgaccatcctggacgtggacctccgccccgccagcgcctggaccctgtacgccgtcgcgaccacgatcctgacccccatgctccggcacaccatcgagaacaccagcgccaacctgtccctggccgccatcgccaaccaggcggccgtgctcatggggctgggcaagggctggcccctgcaccgcatggacctcggggtgccgctgctggccatgggctgctacagccaggtcaaccccacgaccctcaccgcctccctggtgatgctgagcgtgcactacgcgatcatcgggcccggcctccaggccaaggccacccgggaggcccagaagcgctccgccgcgggcatcatgaagaaccccacggtcgacgggatcaccgtgatcgacctggagccgatcagctacgaccccaagttcgagaagcagctgggccaggtgatgctcctggccctgtgcgccgggcagctcctgctgatgcggaccacctgggccttctgcgaggtcctcacgctggccaccggccccatcctgaccctctgggaggggaaccccggccgcttctggaacaccacgatcccggtgtccaccgcgaacatcttccggggcagctacctggccggggccggcctggccttctccctcatcaagaacgcccagacgccccgccgggggaccggcacgaccggggagaccctgggcgagaagtggaagcgccagctgaacagcctcgaccggaaggagttcgaggagtacaagcgctccggcatcttcgaggtggaccggcacgagatcaagtacaccctgaaggacgggagcaagatcaaccacgcgatgtccacgggcagcatcaagatccgcgggatcgacgagcggggcatggtcaagcccaaggggaaggtggtggaccagggctgcggccgcgggggctggtcccactacaccgccaccgccaagaaggtcaccgaggtgaaggggtacacgaagggcgggcccggccacgaggagccgatccccatggccacctacggctggaacctggtgaagctccacagcggggtcgacgtgttctacaagcccaccgagcaggtcgacaccctgctgtgcgacatcggcgagtccagctccaaccccaccatcgaggaggggcggacgctccgcgtcctgaagatggtggagccgtggctgagcagcaagcccgagttctgcatcaaggtgctcaacccctacatgcccaccgtcatcgaggagctggagaagctgcagcggaagcacggcggctccctggtgcgctgcccgctcagccgcaactccacccacgagatgtactgggtgagcggggtctccggcaacatcgtgagctccgtcaacaccacgagcaagatgctgctgaaccggttcaccacccgccaccggaagcccacctacgagaaggacgtggacctcggggcgggcacgcgctccgtgagcatcgagaccgagaagcccgacatgaccatcatcgggcggcgcctgcagcggctgcgcgaggagcacaaggagacctggcactacgaccaggagaacccgtaccggacgtgggcctaccacggctcctacgaggcccccagcaccggctccgccagctccatggtcaacggggtggtgaagctcctgaccaagccctgggacgtcatccccatggtgacccagctggccatgacggacaccaccccgttcggccagcagcgcgagttcaaggagaaggtgtacaccagcacgccccaccccaagccctggacccggatggtcatgaccaccacggcgaactggctctgggccctcgggggcaagaagaagtccccgcgcctgtgcacctgggaggagttcatcagcaaggtgcggtccaacgccgccatcggggccgtgttccaggaggagcagggctggaccagcgcgagcgaggccgtcaacgactcccgcttctgggagctcgtggacaaggagcgggccctgcaccaggagggcaagtgcgagagctgcgtgtacaacatgatggggaagcgcgagaagaagctgggcgagttcgggcgggccaagggctcccgcgccatctggtacatgtggctcggggcgcggttcctggagttcgaggccctgggcttcctcaacgaggaccactggttcggccgcgagaacagctggtccggggtcgagggcgaggggctgcaccggctgggctacatcctcgaggacatcgacaagaaggacggcgacctgatctacgccgacgacaccgccgggtgggacacgcgcatcaccgaggacgacctgctcaacgaggagctgatcaccgagcagatggcgccccaccaccgcatcctggccaaggccatcttcaagctcacctaccacagcaaggtgatgaaggtgctgcggcccacgcccaagggcgccgtcatggacatcatctcccgcaaggaccagcgggggagcggccaggtggggacctacggcctgaacaccttcaccaacatggaggtgcagctcatccgccagatggaggccgagggcgtcatcacgcaggacgacatgcagaacccgaaggggctgaaggagcgggtggagaagtggctgaaggagtgcggcgtggaccgcctcaagcggatggcgatctccggggacgactgcgtcgtgaagcccctggacgagcgcttcagcacctccctcctgttcctgaacgacatgggcaaggtgcggaaggacatcccccagtgggagcccagcaaggggtggaagaactggcaggaggtcccgttctgctcccaccacttccacaagatcttcatgaaggacggccgcagcctggtggtgccctgccggaaccaggacgagctcatcggccgcgcccggatctcccagggggccggctggagcctgcgcgagaccgcctgcctggggaaggcctacgcgcagatgtggtccctcatgtacttccaccggcgcgacctgcggctggccagcatggccatctgcagcgccgtccccaccgagtggttccccacctcccgcacgacctggagcatccacgcccaccaccagtggatgaccaccgaggacatgctcaaggtgtggaaccgggtgtggatcgaggacaacccgaacatgacggacaagacccccgtccactcctgggaggacgtgccctacctgggcaagcgcgaggacctgtggtgcgggagcctcatcggcctgtccagccgcgcgacctgggccaagaacatccacaccgccatcacccaggtgcggaacctgatcggcaaggaggagtacgtcgactacatgcccgtgatgaagcgctactccgccccgatcgagagcgagggggtgctctga

SEQ ID NO: 10432 - RNA, 9867 nt, synthetic construct
  misc_feature 1..9867: note = derived and/or modified CDS sequence (opt1) from DENV-4__JQ922559__SS-prME
  source 1..9867: mol_type = other RNA
agcaccatcaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccagcgcctgggtgatgtacgggacctgcacccagtccggggagcggcgccgggagaagcgcagcgtggccctgaccccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtgttcttcatcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgacgaccatggcccagggcaagcccaccctggacttcgagctcatcaagaccacggccaaggaggtcgccctgctgcggacctactgcatcgaggcgtccatcagcaacatcaccaccgccacgcgctgcccgacccagggggagccctacctcaaggaggagcaggaccagcagtacatctgccggcgcgacgtggtggaccggggctgggggaacggctgcggcctgttcgggaagggcggggtcgtgacctgcgccaagttcctgtgctccggcaagatcaccgggaacctcgtgcagatcgagaacctggagtacacggtcgtggtgaccgtccacaacggcgacacccacgccgtgggcaacgacatcagcatccacggggtcaccgccacgatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggacggcgggcgccgacaccagcgaggtgcagtggaactacaaggagcgcatggtgaccttcaaggtcccgcacgccaagcggcaggacgtgaccgtgctggggtcccaggagggcgccatgcacagcgccctgaccggcgcgacggaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacccagcacgggaccacggtggtcaaggtgaagtacgagggcgccggggccccctgcaaggtgcccatcgagatccgggacgtcaacaaggagaaggtggtgggccgcatcatcagctccacccccttcgcggagaacacctacagcgtcaccaacatcgagctggagccgcccttcggggactcctacatcatcatcggcgtgggcgacagcgccctcacgctgcactggttccggaaggggtccagcatcggcaagatgttcgagtccacctaccgcggggccaagcggatggccatcctgggcgagaccgcgtgggacttcgggagcgtgggcggcctcctgacctccctggggaaggccgtccaccaggtgttcggcagcgtgtacacgaccatgttcgggggcgtctcctggatggtgcgcatcctcatcgggctgctggtgctgtggatcggcaccaacagccggaacacctccatggccatgagctgcatcgccgtcggcgggatcaccctcttcctgggcttcaccgtgcacgccgacatggggtgcgcggtgtcctggagcggcaaggagctgaagtgcgggagcggcatcttcgtcatcgacaacgtgcacacctggaccgagcagtacaagttccagcccgagtcccccgcccgcctcgccagcgccatcctgaacgcccacaaggacggcgtgtgcgggatccggtccacgacccgcctggagaacgtcatgtggaagcagatcaccaacgagctcaactacgtgctgtgggagggcgggcacgacctgaccatcgtggcgggcgacgtcaagggcgtgctcagcaaggggaagcgggccctggccccgcccgtgaacgacctgaagtactcctggaagacgtggggcaaggccaagatcttcacccccgagacccgcaacagcaccttcctcatcgacgggcccgacacgtccgagtgcccgaacgagcggcgcgcctggaacttcctggaggtcgaggactacggcttcgggatgttcaccaccaacatctggatgaagttccgggagggcagctccgaggtgtgcgaccaccgcctgatgagcgcggccatcaaggaccagaaggccgtgcacgccgacatgggctactggatcgagtccagcaagaaccagacctggcagatcgagaaggcgtccctcatcgaggtcaagacgtgcctgtggcccaagacccacaccctgtggagcaacggggtgctcgagtcccagatgctgatccccaaggcctacgccggcccgttcagccagcacaactaccggcaggggtacgccacccagacggtgggcccctggcacctggggaagctcgagatcgacttcggcgagtgccccggcaccaccgtcaccatccaggaggactgcgaccaccgcgggccctccctgcggaccacgaccgccagcggcaagctggtgacccagtggtgctgccgcagctgcaccatgccgcccctccgcttcctgggggaggacggctgctggtacgggatggagatccggcccctgtccgagcgcgaggagaacatggtcaagagccaggtctccgcgggccagggcacgagcgagaccttctccatggggctcctgtgcctgaccctcttcgtggaggagtgcctgcggcgccgggtgacccgcaagcacatgatcctggtcgtggtcacgaccctctgcgccatcatcctgggcgggctgacctggatggacctcctgcgggccctgatcatgctcggcgacaccatgagctcccgcatgggcgggcagatccacctggccatcatggccgtgttcaagatgagccccggctacgtgctggggatcttcctccggaagctgacgtcccgcgagaccgcgctgatggtcatcggcatggccatgaccaccgtgctcagcatcccgcacgacctgatggagttcatcgacgggatctccctgggcctcatcctgctgaagatggtgacgcacttcgacaacacccagatgggcaccctcgccctgagcctgaccttcatcaagtccacgatgcccctcgtcatggcctggcggaccatcatggccgtgctgttcgtggtcaccctgatccccctctgccgcaccagctgcctgcagaagcagtcccactgggtggagatcacggcgctgatcctcggggcccaggccctgcccgtgtacctgatgaccctcatgaagggcgccagcaagcggtcctggccgctgaacgaggggatcatggcggtcggcctggtgagcctcctggggtccgccctgctcaagaacgacgtgcccctggccggccccatggtcgccggcgggctgctcctggccgcgtacgtgatgagcggcagctccgccgacctgagcctcgagaaggccgccaacgtgcagtgggacgagatggccgacatcaccgggtccagccccatcatcgaggtcaagcaggacgaggacggctccttcagcatccgcgacgtggaggagaccaacatgatcacgctgctggtgaagctcgcgctgatcaccgtctccgggctgtacccgctcgccatccccgtgaccatgaccctgtggtacatgtggcaggtcaagacgcagcggagcggcgccctgtgggacgtcccctcccccgccgccgcgcagaaggccaccctcaccgagggcgtgtaccgcatcatgcagcgggggctgttcggcaagacccaggtgggggtcggcatccacatggagggggtgttccacacgatgtggcacgtgacccgcggcagcgtcatctgccacgagtccggccggctggagccgagctgggccgacgtgcgcaacgacatgatctcctacgggggcgggtggcggctcggcgacaagtgggacaaggaggaggacgtgcaggtcctggccatcgagcccggcaagaaccccaagcacgtgcagaccaagcccgggctgttcaagaccctcaccggcgagatcggggccgtgacgctggacttcaagccgggcaccagcgggtcccccatcatcaaccgcaagggcaaggtcatcggcctgtacgggaacggcgtggtgaccaagagcggggactacgtctccgcgatcacccaggccgagcgcatcggcgagcccgactacgaggtggacgaggacatcttccggaagaagcgcctcacgatcatggacctgcacccgggggccggcaagaccaagcggatcctgcccagcatcgtgcgcgaggccctgaagcggcgcctccggaccctgatcctggcgcccacccgcgtcgtggccgccgagatggaggaggccctccggggcctgcccatccgctaccagacgccggccgtgctgtccgagcacaccgggcgggagatcgtcgacctcatgtgccacgcgaccttcaccacgcgcctgctgagcagcacccgggtgcccaactacaacctcatcgtgatggacgaggcccacttcaccgacccctccagcgtcgccgcccgcggctacatctccacccgggtggagatgggggaggccgcggccatcttcatgacggccacgccgcccggcaccaccgaccccttcccccagagcaactcccccatcgaggacatcgagcgcgagatccccgagcggagctggaacacggggttcgactggatcaccgactaccagggcaagaccgtgtggttcgtcccctccatcaaggccggcaacgacatcgccaactgcctgcgcaagagcgggaagaaggtgatccagctgtcccggaagaccttcgacacggagtaccccaagaccaagctcaccgactgggacttcgtcgtgaccacggacatcagcgtgatgggcgcgaacttccgcgccgggcgcgtcatcgacccccggcgctgcctgaagccggtgatcatcaccgacggccccgagcgggtgatcctggccgggcccatccccgtcaccccggcctccgcggcccagcgccggggccgcatcggccggaaccccgcccaggaggacgaccagtacgtgttcagcggggaccccctccgcaacgacgaggaccacgcccactggaccgaggccaagatgctgctggacaacatctacacgcccgagggcatcatcccgaccctcttcgggcccgagcgggagaagacccaggcgatcgacggcgagttccgcctgcggggcgagcagcgcaagaccttcgtggagctgatgcggcgcggggacctccccgtctggctgtcctacaaggtggccagcgccggcatctcctacaaggaccgggagtggtgcttcacgggggagcgcaacaaccagatcctggaggagaacatggaggtggagatctggacccgggagggcgagaagaagaagctccgccccaagtggctggacgcccgggtctacgccgacccgatggcgctgaaggacttcaaggagttcgccagcgggcgcaagtccatcaccctcgacatcctgaccgagatcgccagcctgcccacgtacctctccagccgggccaagctggccctggacaacatcgtgatgctccacaccaccgagcgcggcggcaaggcgtaccagcacgccctgaacgagctgcccgagagcctcgagaccctgatgctggtggccctcctgggggccatgaccgcgggcatcttcctgttcttcatgcaggggaagggcatcggggagctctccatgggcctgatcgccatcgccggcgccagcgggctgctctggggcacgaagaccccgccgccctggggcgccgcgtccaacatcctggagttcttcctgatggtcctcctgatccccgagccggagaagcagcgcacgccccaggacaaccagctgatctacgtgatcctcaccatcctgacgatcatcggcctggtggccgccaacgagatggggctcatcgagaagaccaagaccgacttcggcttctaccaggtcaagaccgagacgaccatcctggacgtggacctgcggcccgccagcgcctggaccctctacgcggtggccaccacgatcctgacccccatgctgcgccacaccatcgagaacacctccgccaacctcagcctggccgccatcgcgaaccaggccgccgtcctgatgggcctcgggaagggctggccgctgcaccggatggacctgggggtgcccctcctggccatgggctgctactcccaggtgaaccccacgaccctgatcgccagcctcgtcatgctgctggtgcactacgcgatcatcggccccgggctccaggccaaggccacccgcgaggcccagaagcggaccgcggccggcatcatgaagaacccgacggtggacgggatcaccgtcatcgacctggagcccatctcctacgaccccaagttcgagaagcagctgggccaggtgatgctcctggtgctgtgcgccgggcagctcctgctgatgcgcaccacctgggccttctgcgaggtcctcacgctggccaccggccccatcctgaccctctgggagggcaacccggggcggttctggaacaccacgatcgcggtgagcaccgccaacatcttccgcggctcctacctggccggggccggcctggccttcagcctcatcaagaacgcgcagacgccccggcgcgggaccggcgtgacgggcgagaccctgggggagaagtggaagcggcagctgaactccctcgaccgcaaggagttcgaggagtacaagcggagcggcatcctggaggtcgaccgcaccgaggccaagtccgccctgaaggacgggagcaagatcaagcaggccgtgtcccggggcaccagcaagatccgctggatcgtggagcgggggatggtcaagcccaagggcaaggtggtggacctcggctgcgggcgcggcgggtggtcctactacatggccacgctgaagaacgtcaccgaggtgaagggctacaccaagggcgggcccggccacgaggagccgatccccatggcgacctacgggtggaacctggtgaagctccacagccgggtcgacgtgttctacaagcccaccgagcaggtcgacacgctgctgtgcgacatcggcgagagctccagcaaccccaccatcgaggaggggcgcaccctccgcgtcctgaagatggtggagccgtggctgtccagcaagcccgagttctgcatcaaggtgctgaacccctacatgcccaccgtcatcgaggagctcgagaagctgcagcggaagcacggcggctccctggtgcgctgcccgctcagccggaactccacgcacgagatgtactgggtgagcggggtctccggcaacatcgtgagctccgtcaacaccaccagcaagatgctgctgaaccgcttcaccacgaagcaccggaagcccacctacgagaaggacgccgacctcggggccggcacccgctccgtgagcaccgagacggagaagcccgacatgaccatcatcgggcggcgcctgcagcggctgcaggaggagcaccaggagacctggcactacgaccaggagaacccgtaccgcacctgggcctaccacggcggctacgaggcgccctccacggggagcgcctccagcatggtgaacggcgtcgtgaagctcctgaccaagccctgggacgtgatccccatggtcacccagctggccatgaccgacacgaccccgttcgggcagcagcgggtgttcaaggagaaggtggacacccgcacgccccagcccaagcccggcacgcggatggtcatgaccaccaccgccaactggctctgggccctgctggggaagaagaagaacccgcgcctctgcacgcgggaggagttcatctccaaggtgcgcagcaacgcggccatcggcgccgtgagccaggaggagcagggctggacctccagcttcgaggccgtcaacgactcccggttctgggagctggtggacaaggagcgcgccctgcaccaggaggggaagtgcgagagctgcgtgtacaacatgatgggcaagcgggagaagaagctcggggagttcggccgcgcgaaggggtcccgggccatctggtacatgtggctgggcgcccgcttcctggagttcgaggccctcggcttcctgaacgaggaccactggttcgggcgcgagaacagctggtccggcgtcgagggggagggcctgcaccggctcggctacatcctggaggacctggacaagcgcgaccggagcctcgtgttcgccgacgacaccgcggggtgggacaccaagatccccgaggacgacctgctgaaggagaagcccatccccggcccgatggcgccccaccagcgcatccccgcccgggccatcttcaagctcacgtaccagaacaaggtggtcaaggtgctgcgcctgaagctcaagggggcggtgatggacatcatctcccggaaggagcagcgcggcagcgggcaggtcggcacctacggcctgaacaccttcaccaacatggaggtgcagctgatccggcagatggaggccgagggggtgatcacgcgcgacgacatgcacaaccccaagggcctcaaggagcgggtcgagaagtggctgaaggagtgcggggtggaccgcctggagcggatggccatctccggcgacgactgcgtggtcaagccgctcgacgagcgcttcagcacctccctgctgttcctcaacgacatggggaaggtgcggaaggacatcccccagtgggagcccagcaagggctggaagaactggcaggaggtgcccttctgctcccaccacttccacaagatcttcatgaaggacggccgcagcctggtcgtgccgtgccggaaccaggacgagctgatcgggcgcgcccggatctcccagggcgccgggtggagcctccgcgagaccgcgtgcctgggcaaggcctacgcccagatgtggagcctgatgtacttccaccgccgggacctccgcctggcctccatggccatctgcagcgcggtgcccaccgagtggttccccacctcccggacgacctggagcatccacgcccaccaccagtggatgaccaccgaggacatgctgaaggtctggaaccgcgtgtggatcgaggacaaccccaacatgacggacaagaccccggtgcactcctgggaggacatcccctacctcgggaagcgggaggacctgtggtgcggcagcctgatcggcctctccagccgcgccacctgggccaagaacatccacaccgccatcacgcaggtccggaacctgatcgggatcgagggctacgtggactacttcctgctcatcaagtggtactccgcgcccttcgagagcgagggggtgctgtga

SEQ ID NO: 10433 - RNA, 9867 nt, synthetic construct
  misc_feature 1..9867: note = derived and/or modified CDS sequence (opt1) from DENV-4__KF955510__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcgcctgggtcatgtacggcacctgcacccagtccggggagcggcgccgggagaagcgcagcgtggccctgaccccgcactccggcatgggcctcgagacgcggaccgagacctggatgagctccgagggggcctggaagcacgcccagcgcgtggagagctggatcctgcggaagcccggcttcgcgctgtccgccgggttcatggcctacatgatcggccagaccgggatccagcgcacggtcttcttcatcctcatgatgctggtggcccccagctacggcatgcggtgcgtgggcgtcgggaaccgcgacttcgtggagggcgtgtccgggggcgcgtgggtcgacctggtgctcgagcacggcgggtgcgtgaccaccatggcccagggcaagcccaccctggacttcgagctgatcaagacgaccgccaaggaggtcgccctcctgcggacctactgcatcgaggccagcatctccaacatcaccacggcgacccgctgcccgacccagggggagccctacctgaaggaggagcaggaccagcagtacatctgccggcgcgacatggtggaccggggctgggggaacggctgcggcctcttcgggaagggcggggtggtcacctgcgccaagttcagctgctccggcaagatcacggggaacctggtgcagatcgagaacctggagtacaccgtggtcgtgaccgtgcacaacggcgacacccacgccgtcggcaacgacacgagcaaccacggggagaccgccaccatcaccccccgctcccccagcgtggaggtccggctcccggactacggcgagctgacgctggactgcgagccccgctccgggatcgacttcaacgagatgatcctcatgaagatgaagaccaagacctggctggtgcacaagcagtggttcctggacctccccctgccctggaccgccggcgcggacaccagcgaggtgcactggaaccacaaggagcggatggtcacgttcaaggtgccgcacgccaagcgccaggacgtgaccgtcctggggagccaggagggcgccatgcactccgccctcgccggcgcgaccgaggtggacagcggggacggcaaccacatgttcgccgggcacctgaagtgcaaggtgcgcatggagaagctgcggatcaagggcatgtcctacaccatgtgcagcggcaagttctccatcgacaaggagatggccgagacgcagcacgggaccaccgtcgtgaaggtgaagtacgagggcaccggggccccctgcaaggtccccatcgagatccgcgacgtgaacaaggagaaggtggtcggccggatcatcagctccacgcccttcgccgagaacaccaacagcgtgaccaacatcgagctcgagccgcccttcggggactcctacatcgtgatcggcgcgggcgacagcgccctgaccctgcactggttccgcaaggggtccagcatcggcaagatgttcgagtccacgtaccggggggccaagcgcatggccatcctcggcgagaccgcgtgggacttcgggagcgtcggcggcctgctgacctccctcgggaaggccgtgcaccaggtgttcggcagcgtctacaccacgatgttcgggggcgtgtcctggatggtgcggatcctgatcgggctgctcgtcctgtggatcggcaccaacagccgcaacacctccatggccatgagctgcatcgtggtgggcgggatcaccctgttcctgggcttcacggtccacgccgacatggggtgcgtggtgagctggtccggcaaggagctcaagtgcgggagcggcatcttcgtcatcgacaacgtgcacacctggaccgagcagtacaagttccagcccgagtcccccgcccggctggcgagcgccatcctgaacgcccacaaggacggcgtgtgcgggatccgctccaccacgcggctcgagaacgtcatgtggaagcagatcaccaacgagctgaactacgtgctgtgggagggcgggcacgacctcaccgtggtcgccggcgacgtgaagggcgtgctgagcaaggggaagcgcgccctggcgccgcccgtcaacgacctcaagtactcctggaagacctggggcaaggccaagatcttcacgcccgagacccggaacagcaccttcctggtggacgggcccgacacctccgagtgcccgaacgagcgccgggcctggaacttcctggaggtggaggactacggcttcgggatgttcacgaccaacatctggatgaagttccgcgagggcagctccgaggtctgcgaccaccggctcatgagcgccgccatcaaggaccagaaggcggtgcacgccgacatgggctactggatcgagtccagcaagaaccagacctggcagatcgagaaggcctccctgatcgaggtgaagacctgcctgtggcccaagacgcacaccctctggagcaacggggtcctggagtcccagatgctgatccccaaggcctacgcgggcccgatcagccagcacaactaccgccaggggtacgccacccagaccgtgggcccctggcacctcgggaagctggagatcgacttcggcgagtgccccggcaccacggtgaccatccaggaggactgcgaccaccgggggcccagcctgcgcaccaccacggcctccggcaagctcgtcacccagtggtgctgccgcagctgcaccatgccgcccctgcggttcctgggggaggacggctgctggtacgggatggagatccgccccctcaacgagaaggaggagaacatggtgaagtcccaggtgagcgccggccagggcacctccgagacgttcagcatggggctgctgtgcctcaccctgttcgtcgaggagtgcctgcggcgccgggtgacccgcaagcacatgatcctcgtcgtggtgaccacgctgtgcgccatcatcctgggcgggctcacctggatggacctgctgcgggcgctcatcatgctgggcgacaccatgtccggccgcatggggggccagatccacctggccatcatggccatgttcaagatgagccccgggtacgtcctcggcatcttcctgcggaagctgacctcccgcgagacggccctcatggtgatcgggatggccatgaccaccgtgctgagcatcccgcacgacctgatggagttcatcgacggcatctccctcggcctgatcctgctcaagatggtcacccacttcgacaacacgcaggtggggaccctggcgctgagcctcaccttcatcaagtccaccatgcccctggtgatggcctggcggacgatcatggccgtcctgttcgtggtgaccctcatccccctgtgccgcaccagctgcctgcagaagcagtcccactgggtcgagatcaccgccctcatcctgggcgcccaggcgctgcccgtgtacctcatgacgctgatgaagggggccagcaagcggtcctggccgctgaacgagggcatcatggccgtggggctcgtcagcctgctgggctccgccctcctgaagaacgacgtgcccctggcgggccccatggtggccgggggcctcctgctggccgcctacgtcatgagcgggagctccgccgacctcagcctggagaaggcggccaacgtgcagtgggacgagatggccgacatcaccggctccagccccatcatcgaggtgaagcaggacgaggacgggtccttcagcatccgcgacgtcgaggagaccaacatgatcaccctgctcgtgaagctggccctgatcacggtgtccggcctctacccgctggccatccccgtcaccatgaccctgtggtacatgtggcaggtgaagacccagcggagcggcgcgctctgggacgtgccctcccccgccgccgcccagaaggccacgctgaccgagggggcgtaccgcatcatgcagcggggcctgttcgggaagacccaggtcggcgtggggatccacatggagggcgtgttccacaccatgtggcacgtcacccgcggcagcgtgatctgccacgagtccgggcggctcgagccgagctgggccgacgtgcgcaacgacatgatctcctacggcgggggctggcggctgggcgacaagtgggacaaggaggaggacgtccaggtgctggccatcgagcccgggaagaaccccaagcacgtgcagacgaagcccggcctcttcaagaccctgaccggggagatcggcgccgtcaccctggacttcaagccggggacgagcggctcccccatcatcaaccgcaagggcaaggtgatcgggctctacggcaacggggtggtcaccaagagcggcgactacgtgtccgccatcacccaggcggagcgcatcggggagcccgactacgaggtggacgaggacatcttccggaagaagcgcctgaccatcatggacctgcacccgggcgccggcaagacgaagcggatcctccccagcatcgtccgcgaggccctgaagcggcgcctgcggaccctgatcctcgcccccacccgcgtggtggcggccgagatggaggaggccctgcgggggctgcccatccgctaccagaccccggccgtcaagtccgagcacacgggccgggagatcgtggacctcatgtgccacgccaccttcaccacccgcctgctgagcagcacgcgggtgcccaactacaacctcatcgtcatggacgaggcgcacttcaccgacccctccagcgtggccgcccgcgggtacatctccacccgggtggagatgggcgaggccgccgcgatcttcatgaccgccacgcccccggggaccaccgaccccttcccccagagcaactcccccatcgaggacatcgagcgcgagatcccggagcggagctggaacaccggcttcgactggatcacggactaccagggcaagaccgtctggttcgtgccctccatcaaggccgggaacgacatcgccaactgcctgcgcaagagcggcaagaaggtcatccagctgtcccggaagaccttcgacaccgagtaccccaagacgaagctcaccgactgggacttcgtggtgaccaccgacatcagcgagatgggggccaacttccgcgcgggccgcgtcatcgacccccggcgctgcctgaagccggtgatcctgacggacgggcccgagcgggtgatcctcgccggccccatccccgtcaccccggcctccgccgcgcagcgccggggccgcatcgggcggaaccccgcccaggaggacgaccagtacgtgttcagcggcgaccccctgcgcaacgacgaggaccacgcccactggaccgaggccaagatgctgctcgacaacatctacacccccgaggggatcatcccgacgctgttcggccccgagcgggagaagacccaggccatcgacggcgagttccgcctgcggggggagcagcgcaagaccttcgtggagctcatgcggcgcggcgacctgcccgtctggctgtcctacaaggtggcgagcgccgggatctcctacaaggaccgggagtggtgcttcaccggcgagcgcaacaaccagatcctcgaggagaacatggaggtggagatctggacgcgggagggggagaagaagaagctgcgccccaagtggctggacgcccgggtctacgccgacccgatggccctcaaggacttcaaggagttcgcgagcggccgcaagtccatcaccctggacatcctgaccgagatcgccagcctccccacctacctgtccagccgggccaagctggccctcgacaacatcgtgatgctgcacaccacggagcgcggcgggaaggcctaccagcacgcgctgaacgagctccccgagagcctggagaccctgatgctcgtggccctgctgggcgccatgaccgccgggatcttcctcttcttcatgcagggcaaggggatgggcaagctgtccatgggcctgatcgcgatcgccgtcgccagcgggctcctgtgggtggccgagatccagccgcagtggatcgccgcgtccatcatcctggagttcttcctcatggtgctgctggtccccgagcccgagaagcagcgcaccccccaggacaaccagctcatctacgtgatcctgacgatcctgaccatcatcgccctcgtggccgccaacgagatgggcctgatcgagaagaccaagaccgacttcgggttctaccaggccaagacggagaccaccatcctggacgtcgacctccggccggcgagcgcctggaccctgtacgccgtggccacgaccatcctgacccccatgctccgccacaccatcgagaacacgtccgccaacctgagcctggcggccatcgccaaccaggccgccgtgctcatgggcctggggaagggctggcccctgcaccggatggacctcggcgtccccctgctggcgatggggtgctactcccaggtgaacccgaccaccctcaccgccagcctggtgatgctgctcgtccactacgccatcatcggccccgggctgcaggccaaggcgacgcgcgaggcccagaagcggaccgccgccggcatcatgaagaaccccaccgtggacggcatcaccgtgatcgacctggagcccatctcctacgacccgaagttcgagaagcagctcgggcaggtcatgctgctggtgctctgcgccggccagctgctgctcatgcgcacgacctgggcgttctgcgaggtgctgaccctggccaccgggcccatcctcacgctgtgggagggcaaccccgggcggttctggaacaccaccatcgccgtcagcaccgccaacatcttccgcggctcctacctggccggcgcggggctcgccttcagcctgatcaagaacgcccagacgccccggcgcggcaccgggaccaccggcgagacgctgggggagaagtggaagcggcagctcaactccctggaccgcaagggcttcgaggagtacaagcggagcggcatcctggaggtggaccgcaccgaggccaagtccgccctcaaggacgggagcaagatcaagtacgcggtgtcccggggcaccagcaagatccgctggatcgtcgagcgggggatggtgaagccgaagggcaaggtggtcgacctggggtgcggccgcggcgggtggtcctactacatggccaccctgaagaacgtgaccgaggtgaagggctacacgaaggggggccccgggcacgaggagcccatccccatggccacctacggctggaacctcgtcaagctgcacagcggcgtggacgtgttctacaagccgaccgagcaggtcgacaccctgctctgcgacatcggggagagctccagcaaccccacgatcgaggagggccggaccctgcgcgtgctgaagatggtggagccctggctctccagcaagcccgagttctgcatcaaggtcctgaacccgtacatgcccaccgtgatcgaggagctggagaagctgcagcgcaagcacgggggctccctcgtgcggtgccccctgagccgcaactccacccacgagatgtactgggtcagcggcgtgtccgggaacatcgtcagctccgtgaacacgaccagcaagatgctgctcaaccggttcaccacccgccaccggaagcccacgtacgagaaggacgccgacctgggcgcggggacccgctccgtgagcaccgagaccgagaagccggacatgacgatcatcggccggcgcctgcagcggctccaggaggagcacaaggagacctggcactacgaccacgagaacccctaccgcacctgggcctaccacgggtcctacgaggcccccagcaccggctccgccagctccatggtcaacggcgtggtgaagctgctgacgaagccgtgggacgtcgtgcccatggtgacccagctcgccatgaccgacaccacgcccttcgggcagcagcgggtcttcaaggagaaggtggacacccgcaccccccagccgaagcccggcacccgggtggtcatgacgaccaccgcgaactggctgtgggccctgctcgggcgcaagaagaacccccggctgtgcacccgcgaggagttcatcagcaaggtgcggagcaacgccgccatcggcgccgtgttccaggaggagcaggggtggacgtccgcgagcgaggccgtcaacgactcccgcttctgggagctggtggacaaggagcgggccctccaccaggagggcaagtgcgagagctgcgtgtacaacatgatgggcaagcgcgagaagaagctgggggagttcggccgggccaaggggtcccgcgccatctggtacatgtggctgggcgcgcgcttcctcgagttcgaggccctggggttcctgaacgaggaccactggttcggccgggagaacagctggtccggcgtcgagggggagggcctccaccgcctggggtacatcctggaggacatcgacaagaaggacggcgacctcatctacgccgacgacaccgccggctgggacacccggatcaccgaggacgacctgctgaacgaggagctcatcacggagcagatggcgccccaccacaagatcctggccaaggccatcttcaagctgacctaccagaacaaggtggtgaaggtcctccgcccgacccccaagggggccgtgatggacatcatcagccggaaggaccagcgcggctccgggcaggtgggcacctacgggctgaacaccttcacgaacatggaggtccagctgatccggcagatggaggccgagggcgtgatcacccgcgacgacatgcacaaccccaagggcctcaaggagcgggtggagaagtggctgaaggagtgcggggtcgaccgcctgaagcggatggcgatcagcggcgacgactgcgtggtgaagcccctcgacgagcgcttctccaccagcctgctgttcctcaacgacatggggaaggtccggaaggacatcccgcagtgggagccctccaagggctggaagaactggcaggaggtgcccttctgcagccaccacttccacaagatcttcatgaaggacgggcgctccctggtggtcccctgccggaaccaggacgagctgatcggccgcgcccggatcagccagggcgccgggtggtccctccgcgagaccgcctgcctgggcaaggcctacgcgcagatgtggagcctgatgtacttccaccggcgcgacctccgcctggccagcatggccatctgctccgccgtgccgacggagtggttccccaccagccggaccacctggtccatccacgcccaccaccagtggatgacgaccgaggacatgctgaaggtgtggaaccgcgtctggatcgaggacaaccccaacatgatcgacaagacccccgtgcacagctgggaggacatcccgtacctcgggaagcgggaggacctgtggtgcggctccctgatcgggctcagctcccgcgcgacctgggccaagaacatccacacggccatcacccaggtgcggaacctgatcggcaaggaggagtacgtcgactacatgcccgtgatgaagcgctacagcgcccacttcgagtccgagggcgtgctgtga

SEQ ID NO: 10434 - RNA, 9867 nt, synthetic construct
  misc_feature 1..9867: note = derived and/or modified CDS sequence (opt1) from DENV-4__GQ868594__SS-prME
  source 1..9867: mol_type = other RNA
agcaccatgaccctgctctgcctgatccccacggtgatggccttccacctgtccacccgcgacggcgagcccctcatgatcgtggccaagcacgagcgggggcgccccctgctgttcaagaccaccgagggcatcaacaagtgcacgctcatcgccatggacctgggggagatgtgcgaggacaccgtgacctacgagtgccccctgctcgtgaacaccgagcccgaggacatcgactgctggtgcaacctgacgagcgcctgggtgatgtacgggacgtgcacccagtccggggagcggcgccgggagaagcgcagcgtggccctgacgccccactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtgttcttcgtgctgatgatgctggtggcgccctcctacggcatgcggtgcgtgggcgtggggaaccgcgacttcgtggagggcgtgagcgggggcgcctgggtggacctcgtgctggagcacggcgggtgcgtcacgaccatggcccagggcaagcccaccctggacttcgagctcatcaagaccacggccaaggaggtggccctgctgcggacctactgcatcgaggcgtccatcagcaacatcaccaccgccacgcgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttctcctgcagcggcaagatcaccgggaacctggtccagatcgagaacctcgagtacacggtggtggtcaccgtgcacaacggcgacacccacgccgtcggcaacgacatccccaaccacggggtgaccgccacgatcacgccccggtcccccagcgtggaggtcaagctgcccgactacggcgagctgaccctcgactgcgagccccggtccgggatcgacttcaacgagatgatcctgatgaagatgaagaagaagacctggctggtgcacaagcagtggttcctcgacctgcccctgccgtgggcggccggcgccgacacgagcgaggtgcactggaactacaaggagcgcatggtcaccttcaaggtgccccacgccaagcggcaggacgtgatcgtcctcgggtcccaggagggcgccatgcacagcgcgctgaccggcgccaccgaggtggacagcggggacggcaaccacatgttcgccgggcacctgaagtgcaaggtgcgcatggagaagctccgcatcaagggcatgtcctacaccatgtgcagcggcaagttctccatcgacaaggagatggccgagacgcagcacgggaccaccgtcgtgaaggtgaagtacgagggcgccggggcgccctgcaaggtccccatcgagatccgggacgtgaacaaggagaaggtggtcggccgcatcatcagctccaccccgttcgccgagtacacgaacagcgtgaccaacatcgagctggagccgcccttcggggactcctacatcgtgatcggcgtcggcgacagcgccctgaccctccactggttccggaaggggtccagcatcggcaagatgctggagtccacctaccgcggggccaagcggatggcgatcctgggcgagacggcctgggacttcgggagcgtgggcggcctcctgacctccctggggaaggccgtgcaccaggtcttcggcagcgtgtacaccaccatgttcgggggcgtgtcctggatggtccgcatcctcatcgggttcctggtgctgtggatcggcacgaacagccggaacacctccatggccatgacctgcatcgccgtgggcgggatcaccctgttcctcggcttcacggtccacgcggacaccgggtgcgccgtgagctggtccggcaaggagctgaagtgcgggagcggcatcttcgtgatcgacaacgtccacacctggaccgagcagtacaagttccagcccgagagcccggcccgcctggcctccgccatcctcaacgcgcacaaggacggcgtgtgcgggatccggagcacgacccgcctggagaacatcatgtggaagcagatcaccaacgagctgaactacgtgctctgggagggcgggcacgacctgaccgtcgtggccggcgacgtgaagggcgtcctgtccaaggggaagcgggccctcgcgccgcccgtgaacgacctgaagtacagctggaagacgtggggcaaggccaagatcttcacccccgaggcgaagaactccaccttcctgatcgacgggccggacaccagcgagtgccccaacgagcgccgggcctggaacttcctcgaggtggaggactacggcttcgggatgttcacgaccaacatctggatgaagttccgcgagggctccagcgaggtctgcgaccaccggctgatgtccgccgccatcaaggaccagaaggcggtgcacgccgacatgggctactggatcgagagctccaagaaccagacctggcagatcgagaaggccagcctgatcgaggtgaagacctgcctctggcccaagacgcacaccctgtggtccaacggggtcctggagagccagatgctcatcccgaaggcctacgccggccccttctcccagcacaactaccgccaggggtacgcgacccagaccgtgggcccctggcacctggggaagctggagatcgacttcggcgagtgccccggcacgaccgtgaccatccaggaggactgcgaccaccgggggccgagcctccgcaccaccacggcctccggcaagctggtcacccagtggtgctgccggagctgcaccatgccgcccctgcgcttcctcggggaggacggctgctggtacgggatggagatccgccccctgagcgagaaggaggagaacatggtgaagtcccaggtgagcgccggccagggcacctccgagacgttcagcatggggctgctctgcctgaccctgttcgtcgaggagtgcctccggcgccgggtgacccgcaagcacatgatcctggtcgtggtgaccacgctgtgcgccatcatcctcggcgggctgacctggatggacctgctccgggccctgatcatgctgggcgacaccatgtccggccgcatgggcgggcagatccacctcgcgatcatggccgtcttcaagatgagcccggggtacgtgctgggcatcttcctgcggaagctcacctcccgcgagacggccctgatggtgatcgggatggccatgaccaccgtcctgagcatcccccacgacctcatggagttcatcgacggcatctccctgggcctgatcctcctgaagatggtgacccacttcgacaacacccaggtggggaccctggccctcagcctgaccttcatccggtccaccatgcccctggtcatggcgtggcgcacgatcatggccgtcctcttcgtggtcaccctgatccccctgtgccggaccagctgcctccagaagcagtcccactgggtggagatcaccgccctgatcctgggcgcccaggcgctcccggtgtacctgatgacgctgatgaagggggccagcaagcgctcctggcccctcaacgagggcatcatggccgtcgggctggtgagcctgctcggctccgccctgctgaagaacgacgtgcccctcgccggccccatggtcgcgggcgggctgctgctcgccgcctacgtgatgagcgggtccagcgccgacctgagcctggagaaggccgcgaacgtgcagtgggacgagatggccgacatcaccgggtccagcccgatcatcgaggtcaagcaggacgaggacgggtccttcagcatccgggacatcgaggagaccaacatgatcaccctcctggtgaagctggccctcatcacggtgtccggcctgtaccccctggccatccccgtcaccatgaccctctggtacatgtggcaggtcaagacccagcgcagcggcgccctgtgggacgtgccctccccggcggccgcccagaaggccacgctgaccgagggggtctaccggatcatgcagcgcggcctcttcgggaagacccaggtgggcgtggggatccacatggagggcgtcttccacaccatgtggcacgtgacgcggggcagcgtgatctgccacgagaccgggcgcctggagccctcctgggccgacgtccggaacgacatgatcagctacggcgggggctggcgcctgggcgacaagtgggacaaggaggaggacgtccaggtgctcgcgatcgagcccgggaagaaccccaagcacgtccagaccaagccgggcctgttcaagaccctgaccggggagatcggcgccgtgacgctcgacttcaagcccgggacctccggcagccccatcatcaaccggaagggcaaggtgatcgggctgtacggcaacggggtcgtgaccaagtccggcgactacgtgagcgccatcacccaggccgagcgcacgggggagccggactacgaggtcgacgaggacatcttccgcaagaagcggctgaccatcatggacctccaccccggcgcgggcaagaccaagcgcatcctgccctccatcgtgcgggaggccctgaagcgccggctgcgcaccctcatcctggcccccacgcgggtggtcgccgccgagatggaggaggcgctgcgcgggctcccgatccggtaccagacccccgccgtcaagagcgagcacaccggccgcgagatcgtggacctgatgtgccacgccaccttcacgacccggctgctctccagcacccgcgtccccaactacaacctgatcgtgatggacgaggcccacttcaccgacccctccagcgtggccgcgcgggggtacatcagcacgcgcgtcgagatgggcgaggccgccgccatcttcatgaccgccaccccgcccggggcgaccgaccccttcccccagtccaacagcccgatcgaggacatcgagcgggagatccccgagcgctcctggaacacgggcttcgactggatcaccgactaccagggcaagaccgtgtggttcgtccccagcatcaaggccgggaacgacatcgccaactgcctgcggaagtccggcaagaaggtgatccagctcagccgcaagaccttcgacacggagtaccccaagaccaagctgaccgactgggacttcgtggtcaccacggacatctccgagatgggggccaacttccgggcgggccgcgtgatcgacccgcgccggtgcctgaagcccgtgatcagcaccgacgggcccgagcgcgtcatcctcgccggccccatcccggtgacccccgcctccgccgcccagcggcgcggccggatcgggcgcaaccccgcgcaggaggacgaccagtacgtgttcagcggcgaccccctgaagaacgacgaggaccacgcccactggaccgaggccaagatgctgctcgacaacatctacacgccggaggggatcatccccaccctgttcggccccgagcgggagaagaaccaggccatcgacggcgagttccgcctgcgcggggagcagcgcaagaccttcgtcgagctcatgcggcgcggcgacctgcccgtgtggctgtcctacaaggtggccagcgcggggatctcctacaaggaccgggagtggtgcttcaccggcgagcgcaacaaccagatcctcgaggagaacatggaggtcgagatctggacgcgggagggggagaagaagaagctgcgcccgaagtggctggacgcccgggtgtacgccgaccccatggccctcaaggacttcaaggagttcgccagcggccgcaagtccatcaccctggacatcctgaccgagatcgcgagcctccccacctacctgtccagccgggccaagctggccctcgacaacatcgtgatgctgcacacgaccgagcgcggcgggaaggcctaccagcacgcgctgaacgagctcccggagtccctggagaccctgatgctcgtcgccctgctgggcgccatgaccgccgggatcttcctcttcttcatgcagggcaaggggatcggcaagctgagcatgggcctgatcgccatcgcggtggccagcgggctcctgtgggtggccgagatccagccccagtggatcgccgcctccatcatcctggagttcttcctcatggtcctgctgatccccgagcccgagaagcagcggaccccgcaggacaaccagctcatctacgtgatcctgacgatcctgaccatcatcggcctcatcgcggccaacgagatggggctgatcgagaagaccaagaccgacttcggcttctaccaggtgaagacggagaccaccatcctggacgtcgacctccgccccgccagcgcctggaccctgtacgccgtggcgacgaccatcctgacccccatgctccgccacaccatcgagaacacgtccgccaacctgagcctggccgccatcgccaaccaggcggccgtgctcatggggctgggcaagggctggcccctgcaccggatggacctcggggtcccgctgctggccatgggctgctactcccaggtgaaccccaccaccctcatcgccagcctggtgatgctgctcgtccactacgcgatcatcgggcccggcctgcaggccaaggccacccgcgaggcccagaagcggacggccgcgggcatcatgaagaaccccaccgtggacgggatcaccgtgatcgacctggagccgatctcctacgaccccaagttcgagaagcagctcggccaggtcatgctgctggtgctctgcgccgggcagctgctgctcatgcgcaccacgtgggccttctgcgaggtgctgaccctggccaccggccccgtcctcaccctgtgggaggggaaccccggccggttctggaacacgaccatcgccgtgagcaccgcgaacatcttccgcggctcctacctggccggggccggcctcgccttcagcctgatcaagaacgcccagaccccgcggcgcgggacgggcaccaccggggagaccctgggcgagaagtggaagcggcagctcaactccctggaccgcaaggagttcgaggagtacaagcggagcggcatcctggaggtggaccgcacggaggcgaagtccgccctcaaggacgggagcaagatcaagcacgccgtctcccggggcagctccaagatccgctggatcgtggagcgggggatggtgaagcccaagggcaaggtcgtggacctggggtgcggccgcggcgggtggagctactacatggccaccctgaagaacgtgaccgaggtcaagggctacaccaagggcggccccgggcacgaggagcccatcccgatggcgacgtacggctggaacctcgtgaagctgcactccggcgtggacgtcttctacaagcccaccgagcaggtcgacaccctgctctgcgacatcggggagagcagctccaaccccaccatcgaggagggccggaccctgcgcgtgctgaagatggtcgagccctggctcagctccaagccggagttctgcatcaaggtgctgaacccctacatgcccacggtgatcgaggagctggagaagctgcagcggaagcacgggggcagcctcgtccgctgccccctgtcccgcaacagcacccacgagatgtactgggtgtccggcgtcagcgggaacatcgtgtccagcgtgaacaccacctccaagatgctgctcaaccggttcacgacccgccaccggaagccgacctacgagaaggacgtcgacctgggcgccgggacccgcagcgtgtccacggagaccgagaagcccgacatgaccatcatcggccggcgcctgcagcggctccaggaggagcacaaggagacctggcactacgaccaggagaacccctaccgcacgtgggcctaccacgggagctacgaggccccgtccaccggcagcgcctccagcatggtgaacggcgtcgtgaagctgctgaccaagccctgggacgtgatccccatggtcacccagctcgcgatgacggacaccacccccttcgggcagcagcgggtgttcaaggagaaggtggacacccgcacgccgcagcccaagcccggcacccggatggtcatgaccaccacggccaactggctgtgggccctgctcgggaagaagaagaacccccgcctgtgcacccgggaggagttcatctccaaggtgcgcagcaacgccgccatcggcgcggtgttccaggaggagcaggggtggaccagcgcctccgaggccgtcaacgacagccggttctgggagctggtggacaaggagcgcgccctccaccaggagggcaagtgcgagtcctgcgtgtacaacatgatgggcaagcgggagaagaagctgggggagttcggccgcgccaaggggagccgggcgatctggtacatgtggctgggcgcccgcttcctcgagttcgaggccctggggttcctgaacgaggaccactggttcggccgggagaactcctggagcggcgtcgagggggagggcctccaccgcctggggtacatcctggaggacatcgacaagaaggacggcgacctcatctacgccgacgacaccgcgggctgggacacgcgcatcaccgaggacgacctgctgaacgaggagctcatcaccgagcagatggccccgcaccacaagatcctggccaaggccatcttcaagctgacctaccagaacaaggtggtgaaggtcctccggcccacgcccaagggggccgtgatggacatcatctcccgcaaggaccagcggggcagcggccaggtgggcacctacgggctgaacaccttcaccaacatggaggtccagctgatccgccagatggaggcggagggcgtgatcacgcaggacgacatgcacaaccccaagggcctcaaggagcgggtggagaagtggctgaaggagtgcggggtcgaccgcctgaagcggatggccatctccggcgacgactgcgtggtgaagccgctcgacgagcgcttcagcacctccctgctgttcctcaacgacatggggaaggtccggaaggacatcccccagtgggagcccagcaagggctggaagaactggcaggaggtgcccttctgctcccaccacttccacaagatcttcatgaaggacgggcgcagcctggtggtcccgtgccggaaccaggacgagctgatcggccgcgcccggatctcccagggcgccgggtggagcctccgcgagaccgcctgcctgggcaaggcgtacgcccagatgtggtccctgatgtacttccaccggcgcgacctccggctggccagcatggccatctgcagcgccgtgcccaccgagtggttccccacctcccgcacgacctggagcatccacgcgcaccaccagtggatgaccaccgaggacatgctgaaggtgtggaaccgggtctggatcgaggacaaccccaacatgacggacaagaccccggtgcactcctgggaggacatcccctacctcgggaagcgcgaggacctgtggtgcggcagcctgatcgggctctccagccgcgccacctgggccaagaacatccacaccgccatcacccaggtgcggaacctgatcggcaaggaggagtacgtcgactacatgcccgtgatgaagcgctactccgcccccttcgagagcgagggcgtgctgtga

SEQ ID NO: 10435 - RNA, 9867 nt, synthetic construct
  misc_feature 1..9867: note = derived and/or modified CDS sequence (opt1) from DENV-4__FJ024424__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccaccacgatcaccccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgccgacacgtccgaggtgcactggaactacaaggagcgcatggtcaccttcaaggtgccgcacgcgaagcggcaggacgtgaccgtcctcgggagccaggagggcgccatgcacagcgccctggccggcgccaccgaggtggactccggggacggcaaccacatgttcgcggggcacctgaagtgcaaggtgcgcatggagaagctccgcatcaagggcatgagctacacgatgtgctccggcaagttcagcatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatctccagcacgcccctggccgagaacaccaactccgtgaccaacatcgagctggagccgcccttcggggacagctacatcgtcatcggcgtgggcaactccgcgctcaccctgcactggttccggaaggggagctccatcggcaagatgttcgagagcacgtaccgcggggccaagcggatggccatcctgggcgagaccgcctgggacttcgggtccgtgggcggcctcttcaccagcctggggaaggcggtccaccaggtgttcggctccgtgtacaccacgatgttcgggggcgtcagctggatgatccgcatcctgatcgggttcctcgtgctgtggatcggcaccaactcccggaacaccagcatggccatgacctgcatcgccgtgggcgggatcacgctgttcctgggcttcaccgtccaggccgacatggggtgcgtggtgtcctggagcggcaaggagctcaagtgcgggagcggcatcttcgtcgtggacaacgtgcacacctggaccgagcagtacaagttccagcccgagtcccccgcccgcctggcgagcgccatcctgaacgcccacaaggacggcgtctgcgggatccggtccacgacccgcctcgagaacgtgatgtggaagcagatcaccaacgagctgaactacgtgctgtgggagggcgggcacgacctcaccgtcgtggccggcgacgtgaagggcgtcctgacgaaggggaagcgggccctgaccccgcccgtgagcgacctcaagtactcctggaagacctggggcaaggcgaagatcttcacccccgaggcccgcaacagcacgttcctgatcgacgggcccgacacctccgagtgcccgaacgagcggcgcgcctggaacagcctggaggtggaggactacggcttcgggatgttcaccaccaacatctggatgaagttccgggagggctccagcgaggtctgcgaccaccgcctcatgtccgccgccatcaaggaccagaaggcggtgcacgccgacatgggctactggatcgagagctccaagaaccagacgtggcagatcgagaaggccagcctgatcgaggtgaagacctgcctgtggcccaagacccacaccctctggtccaacggggtcctggagagccagatgctgatccccaagtcctacgccggcccgttcagccagcacaactaccggcaggggtacgcgacccagacggtgggcccctggcacctcgggaagctggagatcgacttcggcgagtgccccggcaccaccgtgaccatccaggaggactgcgaccaccgcgggcccagcctgcggacgaccaccgcctccggcaagctcgtcacccagtggtgctgccgcagctgcacgatgccgcccctgcgcttcctgggggaggacggctgctggtacgggatggagatccggcccctctccgagaaggaggagaacatggtgaagagccaggtcgccgccggccagggcacctccgagaccttcagcatggggctgctgtgcctcaccctgttcgtggaggagtgcctgcgccggcgcgtgacgcggaagcacatgatcctcgccgtcgtgatcaccctgtgcgcgatcatcctgggcgggctcacctggatggacctgctgcgcgccctcatcatgctgggcgacaccatgtccggccggatcgggggccagacgcacctggccatcatggccgtgttcaagatgagccccgggtacgtcctcggcgtgttcctgcgcaagctgacctcccgggagaccgccctcatggtgatcgggatggcgatgaccacgaccctgagcatcccgcacgacctgatggagctcatcgacggcatctccctgggcctgatcctcctgaagatcgtcacccagttcgacaacacccaggtggggacgctggccctcagcctgaccttcatccgctccaccatgagcctggtgatggcctggcggaccatcatggccgtcctcttcgtggtgacgctgatccccctgtgccgcacctcctgcctccagaagcagagccactgggtcgagatcaccgccctgatcctgggcgcgcaggccctccccgtgtacctgatgaccctgatgaagggggcctcccggcgcagctggcccctcaacgagggcatcatggccgtggggctggtctccctgctcggcagcgcgctgctgaagaacgacgtgccgctcgccggccccatggtggccgggggcctgctgctcgccgcctacgtcatgagcgggtccagcgcggacctgtccctggagaaggccgccaacgtgcagtgggacgagatggccgacatcacgggcagctcccccatcatcgaggtgaagcaggacgaggacgggagcttctccatccgggacgtcgaggagaccaacatgatcaccctcctggtgaagctggccctcatcaccgtgagcggcctgtaccccctggcgatcccggtcacgatgaccctctggtacatgtggcaggtgaagacccagcgctccggcgccctgtgggacgtgcccagccccgccgccacccagaaggccgcgctgtccgagggggtctaccggatcatgcagcgcggcctcttcgggaagacccaggtgggcgtggggatccacatggagggcgtcttccacacgatgtggcacgtgacccggggcagcgtgatctgccacgagaccgggcgcctggagccctcctgggccgacgtccggaacgacatgatcagctacggcgggggctggcgcctgggcgacaagtgggacaaggaggaggacgtgcaggtgctcgccatcgagccggggaagaaccccaagcacgtccagaccaagcccggcctgttcaagacgctgaccggggagatcggcgccgtgaccctcgacttcaagcccgggacctccggcagcccgatcatcaaccgcaagggcaaggtgatcgggctgtacggcaacggggtcgtgacgaagtccggcgactacgtgagcgccatcacccaggcggagcggatcggggagcccgactacgaggtcgacgaggacatcttccgcaagaagcggctgaccatcatggacctccaccccggcgccggcaagaccaagcgcatcctgccgtccatcgtgcgggaggccctgaagcgccggctgcgcacgctcatcctggcccccacccgggtggtcgcggccgagatggaggaggccctgcgcgggctccccatccggtaccagacccccgccgtgaagagcgagcacaccggccgcgagatcgtggacctgatgtgccacgccacgttcaccacccggctgctcagctccacccgcgtcccgaactacaacctgatcgtgatggacgaggcgcacttcacggaccccagctccgtcgccgcccgggggtacatcagcacccgcgtggagatgggcgaggccgccgcgatcttcatgaccgccaccccccccggggccacggacccgttcccccagtccaacagccccatcgaggacatcgagcgggagatccccgagcgctcctggaacaccggcttcgactggatcaccgactaccagggcaagaccgtgtggttcgtcccgagcatcaaggccgggaacgacatcgccaactgcctgcggaagtccggcaagaaggtgatccagctcagccgcaagacgttcgacaccgagtaccccaagaccaagctgaccgactgggacttcgtggtcacgaccgacatctccgagatgggggcgaacttccgcgccggccgggtgatcgacccccgccggtgcctgaagcccgtgatcctcaccgacgggccggagcgcgtcatcctggccggccccatccccgtgacccccgccagcgcggcccagcggcgcggccggatcgggcgcaacccgacgcaggaggacgaccagtacgtgttctccggcgaccccctgaagaacgacgaggaccacgcccactggaccgaggccaagatgctcctggacaacatctacacccccgaggggatcatccccaccctgttcggcccggagcgggagaagacgcaggccatcgacggcgagttccgcctccggggggagcagcgcaagaccttcgtcgagctgatgcggcgcggcgacctgcccgtgtggctcagctacaaggtggcgtccgccgggatcagctacaaggaccgggagtggtgcttcaccggcgagcgcaacaaccagatcctggaggagaacatggaggtcgagatctggacccgggagggggagaagaagaagctgcgcccccggtggctcgacgcccgcgtgtacgccgaccccatggccctgaaggacttcaaggagttcgcgtccggccggaagagcatcaccctggacatcctcacggagatcgcctccctgccgacctacctgagcagccgcgccaagctcgccctggacaacatcgtgatgctgcacaccaccgagcgcggcgggcgggcctaccagcacgcgctcaacgagctgcccgagtccctggagacgctcatgctggtcgccctgctcggcgccatgaccgccgggatcttcctgttcttcatgcagggcaaggggatcggcaagctgagcatgggcctcatcaccatcgcggtggcctccgggctgctgtgggtggccgagatccagccccagtggatcgccgccagcatcatcctcgagttcttcctgatggtcctgctcatcccggagcccgagaagcagcgcaccccccaggacaaccagctgatctacgtgatcctgacgatcctcaccatcatcggcctgatcgcggccaacgagatggggctgatcgagaagaccaagaccgacttcggcttctaccaggtgaagacggagaccaccatcctcgacgtcgacctgcggcccgcctccgcctggaccctgtacgccgtggcgacgaccatcctcaccccgatgctgcgccacaccatcgagaacacgagcgccaacctgtccctcgccgccatcgccaaccaggcggccgtgctgatggggctgggcaagggctggcccctccaccggatggacctgggggtccccctgctcgccatgggctgctacagccaggtgaaccccaccaccctgaccgcctccctggtgatgctcctggtccactacgccatcatcgggccgggcctgcaggcgaaggccacgcgcgaggcccagaagcggaccgccgcgggcatcatgaagaaccccaccgtggacgggatcaccgtgatcgacctcgagcccatcagctacgaccccaagttcgagaagcagctgggccaggtcatgctgctcgtgctgtgcgccgggcagctgctcctgatgcgcacgacctgggccttctgcgaggtgctgaccctcgccaccggcccgatcctgacgctgtgggaggggaaccccggccggttctggaacaccaccatcgccgtctccaccgcgaacatcttccgcggcagctacctcgccggggccggcctggccttctccctgatcaagaacgcccagacgccccggcgcgggaccggcaccaccggggagaccctcggcgagaagtggaagcggcagctgaacagcctggaccgcaaggagttcgaggagtacaagcggtccggcatcctcgaggtggaccgcacggaggcgaagagcgccctgaaggacgggtccaagatcaagcacgccgtgagccggggctccagcaagatccgctggatcgtcgagcgggggatggtgaagcccaagggcaaggtggtcgacctggggtgcggccgcggcgggtggagctactacatggccaccctcaagaacgtgaccgaggtgaagggctacaccaaggggggcccggggcacgaggagcccatccccatggccacgtacggctggaacctggtcaagctgcactccggcgtggacgtgttctacaagcccaccgagcaggtcgacaccctcctgtgcgacatcggggagagctccagcaacccgaccatcgaggagggccgcacgctgcgggtgctcaagatggtggagccctggctgtccagcaagcccgagttctgcatcaaggtcctgaacccctacatgccgaccgtgatcgaggagctggagaagctccagcgcaagcacgggggcaacctggtccggtgccccctgtcccgcaacagcacccacgagatgtactgggtgtccggcgcgagcgggaacatcgtgtccagcgtcaacaccacgtccaagatgctcctgaaccggttcaccacccgccaccggaagcccacctacgagaaggacgtggacctgggcgccgggacgcgcagcgtgtccaccgagaccgagaagcccgacatgaccatcatcggccggcgcctccagcggctgcaggaggagcacaaggagacgtggcactacgaccaggagaacccgtaccgcacctgggcctaccacgggagctacgaggccccctccaccggcagcgcgtccagcatggtcaacggcgtggtgaagctgctcaccaagccctgggacatgatcccgatggtcacgcagctggccatgaccgacaccacccccttcgggcagcagcgggtgttcaaggagaaggtggacacgcgcaccccccagcccaagccgggcacccggatggtcatgaccacgaccgccaactggctgtgggccctcctggggaagaagaagaacccccgcctgtgcacccgggaggagttcatcagcaaggtgcgctccaacgccgcgatcggcgccgtgttccaggaggagcaggggtggaccagcgcctccgaggccgtcaacgacagccggttctgggagctcgtggacaaggagcgcgccctgcaccaggagggcaagtgcgagtcctgcgtgtacaacatgatgggcaagcgggagaagaagctgggggagttcggccgcgcgaaggggagccgcgccatctggtacatgtggctcggcgcccggttcctggagttcgaggccctggggttcctcaacgaggaccactggttcggccgcgagaactcctggagcggcgtcgagggggagggcctgcaccggctggggtacatcctcgaggagatcgacaagaaggacggcgacctgatgtacgccgacgacacggcgggctgggacacccgcatcaccgaggacgacctgcagaacgaggagctcatcaccgagcagatggccccccaccacaagatcctggccaaggccatcttcaagctgacctaccagaacaaggtggtgaaggtcctccggcccacgccgcgcggggcggtgatggacatcatctcccggaaggaccagcgcggcagcgggcaggtgggcacctacgggctgaacaccttcaccaacatggaggtccagctgatccggcagatggaggccgagggcgtgatcacgcaggacgacatgcagaaccccaagggcctcaaggagcgcgtggagaagtggctgcgggagtgcggggtcgaccgcctgaagcggatggccatctccggcgacgactgcgtggtgaagcccctcgacgagcgcttcgggaccagcctgctgttcctcaacgacatgggcaaggtccggaaggacatcccccagtgggagccgtccaaggggtggaagaactggcaggaggtgcccttctgcagccaccacttccacaagatcttcatgaaggacggccgctccctggtggtcccctgccggaaccaggacgagctgatcggccgcgcccggatcagccagggggccggctggtccctccgcgagaccgcgtgcctggggaaggcctacgcccagatgtggagcctgatgtacttccaccgccgggacctccgcctggccagcatggccatctgctccgcggtgcccaccgagtggttcccgacgagccggaccacctggtccatccacgcccaccaccagtggatgaccacggaggacatgctgaaggtgtggaaccgcgtctggatcgaggacaaccccaacatgatcgacaagacccccgtgcacagctgggaggacatcccctacctcggcaagcgggaggacctgtggtgcgggtccctgatcggcctcagctcccgcgccacctgggccaagaacatccacaccgccatcacgcaggtgcggaacctgatcggcaaggaggagtacgtcgactacatgccggtgatgaagcgctacagcgcgccctccgagagcgagggggtgctgtga

SEQ ID NO: 10436 - RNA, 9867 nt, synthetic construct
  misc_feature 1..9867: note = derived and/or modified CDS sequence (opt1) from DENV-4__EU854295__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctctccgagaaggaggagaacatggtgaagagccaggtcgccgccggccccggcacgtccgagaccttcagcatggggctgctgtgcctcaccctgttcgtggaggagtgcctgcggcgccgggtgacccgcaagcacatgatcctcgcggtcgtgatcacgctgtgcgccatcatcctgggcgggctcacctggatggacctgctgcgggccctcatcatgctgggcgacaccatgtccggccgcatcgggggccagacccacctggccatcatggccgtgttcaagatgagcccggggtacgtcctcggcgtgttcctgcggaagctgacgtcccgcgagaccgcgctcatggtgatcgggatggccatgaccaccacgctgagcatcccccacgacctgatggagctcatcgacggcatctccctgggcctgatcctcctgaagatcgtcacccagttcgacaacacccaggtggggaccctggccctcagcctgacgttcatccggtccaccatgagcctggtgatggcctggcgcaccatcatggccgtcctcttcgtggtgaccctgatccccctgtgccggacgtcctgcctccagaagcagagccactgggtcgagatcaccgcgctgatcctgggcgcccaggccctccccgtgtacctgatgaccctgatgaagggggcctcccgccggagctggccgctcaacgagggcatcatggcggtggggctggtctccctgctcggcagcgccctgctgaagaacgacgtgcccctcgccggccccatggtggccgggggcctgctgctcgccgcgtacgtcatgagcgggtccagcgccgacctgtccctggagaaggccgccaacgtgcagtgggacgagatggccgacatcaccggcagctcccccatcatcgaggtgaagcaggacgaggacgggagcttctccatccgcgacgtcgaggagacgaacatgatcaccctcctggtgaagctggcgctcatcaccgtgagcggcctgtacccgctggccatccccgtcaccatgacgctctggtacatgtggcaggtgaagacccagcggtccggcgccctgtgggacgtgcccagccccgccgccacccagaaggcggccctgtccgagggggtctaccgcatcatgcagcggggcctcttcgggaagacccaggtgggcgtggggatccacatggagggcgtcttccacaccatgtggcacgtgacgcgcggcagcgtgatctgccacgagaccgggcggctggagccgtcctgggccgacgtccgcaacgacatgatcagctacggcgggggctggcgcctgggcgacaagtgggacaaggaggaggacgtgcaggtgctcgccatcgagcccgggaagaaccccaagcacgtccagaccaagcccggcctgttcaagaccctgacgggggagatcggcgccgtgaccctcgacttcaagccggggacctccggcagccccatcatcaaccggaagggcaaggtgatcgggctgtacggcaacggggtcgtgaccaagtccggcgactacgtgagcgcgatcacgcaggccgagcgcatcggggagcccgactacgaggtcgacgaggacatcttccggaagaagcgcctgaccatcatggacctccacccgggcgccggcaagaccaagcggatcctgccctccatcgtgcgcgaggccctgaagcggcgcctgcggaccctcatcctggcgcccacgcgcgtggtcgccgccgagatggaggaggccctgcgggggctccccatccgctaccagaccccggccgtgaagagcgagcacaccggccgggagatcgtggacctgatgtgccacgcgaccttcacgacccgcctgctcagctccacccgggtccccaactacaacctgatcgtgatggacgaggcccacttcaccgaccccagctccgtcgccgcccgcgggtacatcagcacgcgggtggagatgggcgaggccgcggccatcttcatgaccgccacccccccgggggccaccgaccccttcccccagtccaacagccccatcgaggacatcgagcgcgagatcccggagcggtcctggaacacgggcttcgactggatcaccgactaccagggcaagaccgtgtggttcgtccccagcatcaaggccgggaacgacatcgcgaactgcctgcgcaagtccggcaagaaggtgatccagctcagccgcaagaccttcgacacggagtaccccaagaccaagctgaccgactgggacttcgtggtcaccacggacatctccgagatgggggccaacttccgggccggccgcgtgatcgacccccggcgctgcctgaagccggtgatcctcaccgacgggcccgagcgggtcatcctggccggccccatccccgtgaccccggcgagcgccgcccagcgccggggccgcatcgggcggaaccccgcccaggaggacgaccagtacgtgttctccggcgaccccctgaagaacgacgaggaccacgcccactggaccgaggcgaagatgctcctggacaacatctacacgcccgaggggatcatcccgaccctgttcggccccgagcgcgagaagacccaggccatcgacggcgagttccggctccgcggggagcagcggaagaccttcgtcgagctgatgcgccggggcgacctgcccgtgtggctcagctacaaggtggcctccgccgggatcagctacaaggaccgcgagtggtgcttcacgggcgagcggaacaaccagatcctggaggagaacatggaggtcgagatctggacccgcgagggggagaagaagaagctgcggccccgctggctcgacgcccgggtgtacgcggacccgatggccctgaaggacttcaaggagttcgcctccggccgcaagagcatcaccctggacatcctcaccgagatcgcctccctgcccacctacctgagcagccgcgccaagctcgcgctggacaacatcgtgatgctgcacacgaccgagcggggcgggcgcgcctaccagcacgccctcaacgagctgcccgagtccctggagaccctcatgctggtcgccctgctcggcgcgatgaccgccgggatcttcctgttcttcatgcagggcaaggggatcggcaagctgagcatgggcctcatcacgatcgccgtggcctccgggctgctgtgggtggccgagatccagccgcagtggatcgcggccagcatcatcctcgagttcttcctgatggtcctgctcatccccgagcccgagaagcagcggaccccccaggacaaccagctgatctacgtgatcctgaccatcctcaccatcatcggcctgatcgccgccaacgagatggggctgatcgagaagacgaagaccgacttcggcttctaccaggtgaagaccgagaccacgatcctcgacgtcgacctgcgcccggcctccgcgtggaccctgtacgccgtggccaccaccatcctcacgcccatgctgcggcacaccatcgagaacaccagcgccaacctgtccctcgccgcgatcgccaaccaggccgccgtgctgatggggctgggcaagggctggcccctccaccgcatggacctgggggtccccctgctcgccatgggctgctacagccaggtgaacccgaccacgctgaccgcgtccctggtgatgctcctggtccactacgccatcatcgggcccggcctgcaggccaaggccacccgggaggcgcagaagcgcaccgccgccggcatcatgaagaaccccacggtggacgggatcaccgtgatcgacctcgagcccatcagctacgacccgaagttcgagaagcagctgggccaggtcatgctgctcgtgctgtgcgccgggcagctgctcctgatgcggaccacctgggccttctgcgaggtgctgacgctcgcgaccggccccatcctgaccctgtgggaggggaaccccggccgcttctggaacaccacgatcgccgtctccaccgccaacatcttccggggcagctacctcgccggggccggcctggcgttctccctgatcaagaacgcccagaccccccgccgggggaccggcacgaccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgccgtgagccgcggctccagcaagatccggtggatcgtcgagcgcgggatggtgaagccgaagggcaaggtggtcgacctggggtgcggccgcggcgggtggagctactacatggcgaccctcaagaacgtgacggaggtgaagggctacaccaaggggggccccgggcacgaggagcccatccccatggccacctacggctggaacctggtcaagctgcactccggcgtggacgtgttctacaagccgaccgagcaggtcgacacgctcctgtgcgacatcggggagagctccagcaaccccaccatcgaggagggccggaccctgcgcgtgctcaagatggtggagccctggctgtccagcaagcccgagttctgcatcaaggtcctgaacccgtacatgcccaccgtgatcgaggagctggagaagctccagcggaagcacgggggcaacctggtccgctgccccctgtcccggaacagcacgcacgagatgtactgggtgtccggcgccagcgggaacatcgtgtccagcgtcaacaccacctccaagatgctcctgaaccgcttcaccacgcggcaccgcaagcccacctacgagaaggacgtggacctgggcgccgggacccggagcgtgtccaccgagacggagaagccggacatgaccatcatcggccgccggctccagcgcctgcaggaggagcacaaggagacctggcactacgaccaggagaacccctaccggacctgggcgtaccacgggagctacgaggccccctccacgggcagcgcctccagcatggtcaacggcgtggtgaagctgctcaccaagccgtgggacgtcatccccatggtgacccagctggccatgaccgacacgacccccttcgggcagcagcgcgtgttcaaggagaaggtcgacacccggaccccccagccgaagcccggcacgcgcgtggtgatgaccaccaccgccaactggctgtgggcgctcctggggaagaagaagaacccccggctgtgcacgcgcgaggagttcatcagcaaggtccggtccaacgccgccatcggcgccgtgttccaggaggagcaggggtggaccagcgcctccgaggcggtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggcgctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggccccccaccacaagatcctggcgaaggccatcttcaagctgacctaccagaacaaggtcgtgaaggtgctccgcccgaccccccggggggccgtcatggacatcatctcccgcaaggaccagcggggcagcgggcaggtgggcacctacgggctgaacacgttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggccatctccggcgacgactgcgtcgtgaagcccctcgacgagcggttcgggaccagcctgctgttcctcaacgacatgggcaaggtgcgcaaggacatcccgcagtgggagccctccaaggggtggaagaactggcaggaggtccccttctgcagccaccacttccacaagatcttcatgaaggacggccggtccctggtggtgccctgccgcaaccaggacgagctgatcggccgggcgcgcatcagccagggggccggctggtccctccgcgagacggcctgcctggggaaggcctacgcccagatgtggagcctgatgtacttccaccggcgcgacctccggctggcgagcatggccatctgctccgccgtcccgaccgagtggttccccaccagccgcaccacgtggtccatccacgcccaccaccagtggatgaccaccgaggacatgctgaaggtgtggaaccgggtgtggatcgaggacaaccccaacatgatcgacaagacccccgtccacagctgggaggacatcccgtacctcggcaagcgcgaggacctgtggtgcgggtccctgatcggcctcagctcccgggccacgtgggcgaagaacatccacaccgccatcacccaggtgcgcaacctgatcggcaaggaggagtacgtggactacatgcccgtcatgaagcggtacagcgccccctccgagagcgagggggtgctgtga

SEQ ID NO: 10437 - RNA, 9867 nt, synthetic construct
  misc_feature 1..9867: note = derived and/or modified CDS sequence (opt1) from DENV-4__EU854296__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgcgaagggcgtgctgaccaaggggaagcgcgccctgacgccgcccgtcagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacctggcagatcgagaaggcgagcctgatcgaggtgaagacgtgcctgtggcccaagacccacaccctctggtccaacggggtgctggagagccagatgctgatccccaagtcctacgccggcccgttcagccagcacaactaccgccaggggtacgccacccagaccgtcggcccctggcacctcgggaagctggagatcgacttcggcgagtgccccggcacgaccgtgaccatccaggaggactgcgaccaccgggggcccagcctgcgcaccacgaccgcctccggcaagctcgtgacccagtggtgctgccgcagctgcaccatgccgcccctgcggttcctgggggaggacggctgctggtacgggatggagatccgccccctctccgagaaggaggagaacatggtcaagagccaggtgacggccggccagggcacctccgagaccttcagcatggggctgctgtgcctcaccctgttcgtcgaggagtgcctgcggcgccgggtgacgcgcaagcacatgatcctcgcggtggtcatcaccctgtgcgccatcatcctgggcgggctcacctggatggacctgctgcgggccctcatcatgctgggcgacaccatgtccggccgcatcgggggccagacgcacctggccatcatggccgtgttcaagatgagccccgggtacgtgctcggcgtcttcctgcggaagctgacctcccgcgagaccgcgctcatggtgatcgggatggccatgaccacgaccctgagcatcccgcacgacctgatggagctcatcgacggcatctccctgggcctgatcctcctgaagatcgtgacccagttcgacaacacccaggtcgggacgctggccctcagcctgaccttcatccggtccaccatgagcctggtgatggcctggcgcaccatcatggccgtgctcttcgtcgtgacgctgatccccctgtgccggacctcctgcctccagaagcagagccactgggtggagatcaccgcgctgatcctgggcgcccaggccctccccgtctacctgatgaccctgatgaagggggcctcccgccggagctggcccctcaacgagggcatcatggcggtggggctggtgtccctgctcggcagcgccctgctgaagaacgacgtcccgctcgccggccccatggtggccgggggcctgctgctcgccgcgtacgtgatgagcgggtccagcgccgacctgtccctggagaaggccgccaacgtccagtgggacgagatggccgacatcacgggcagctcccccatcatcgaggtgaagcaggacgaggacgggagcttctccatccgcgacgtggaggagaccaacatgatcaccctcctggtcaagctggcgctcatcaccgtgagcggcctgtaccccctggccatcccggtgacgatgaccctctggtacatgtggcaggtcaagacccagcggtccggcgccctgtgggacgtgcccagccccgccgccacccagaaggcggccctgtccgagggggtgtaccgcatcatgcagcggggcctcttcgggaagacccaggtcggcgtggggatccacatggagggcgtgttccacacgatgtggcacgtcacccgcggcagcgtgatctgccacgagaccgggcggctggagccctcctgggccgacgtgcgcaacgacatgatcagctacggcgggggctggcgcctgggcgacaagtgggacaaggaggaggacgtccaggtgctcgccatcgagccggggaagaaccccaagcacgtgcagaccaagcccggcctgttcaagacgctgaccggggagatcggcgccgtcaccctcgacttcaagcccgggacctccggcagcccgatcatcaaccggaagggcaaggtgatcgggctgtacggcaacggggtggtcacgaagtccggcgactacgtgagcgcgatcacccaggccgagcgcatcggggagcccgactacgaggtggacgaggacatcttccggaagaagcgcctgaccatcatggacctccaccccggcgccggcaagaccaagcggatcctgccgtccatcgtccgcgaggccctgaagcggcgcctgcggacgctcatcctggcgcccacccgcgtggtggccgccgagatggaggaggccctgcgggggctccccatccgctaccagacccccgccgtcaagagcgagcacaccggccgggagatcgtggacctgatgtgccacgcgacgttcaccacccgcctgctcagctccacccgggtgccgaactacaacctgatcgtcatggacgaggcccacttcacggaccccagctccgtggccgcccgcgggtacatcagcacccgggtcgagatgggcgaggccgcggccatcttcatgaccgccaccccccccggggccacggacccgttcccccagtccaacagccccatcgaggacatcgagcgcgagatccccgagcggtcctggaacaccggcttcgactggatcaccgactaccagggcaagaccgtgtggttcgtgccgagcatcaaggccgggaacgacatcgcgaactgcctgcgcaagtccggcaagaaggtcatccagctcagccgcaagacgttcgacaccgagtaccccaagaccaagctgaccgactgggacttcgtggtgacgaccgacatctccgagatgggggccaacttccgggccggccgcgtcatcgacccccggcgctgcctgaagcccgtgatcctcaccgacgggccggagcgggtgatcctggccggccccatccccgtcacccccgcgagcgccgcccagcgccggggccgcatcgggcggaacccggcccaggaggacgaccagtacgtgttctccggcgaccccctgaagaacgacgaggaccacgcccactggacggaggcgaagatgctcctggacaacatctacacccccgaggggatcatccccaccctgttcggcccggagcgcgagaagacccaggccatcgacggcgagttccggctccgcggggagcagcggaagacgttcgtggagctgatgcgccggggcgacctgcccgtctggctcagctacaaggtggcctccgccgggatcagctacaaggaccgcgagtggtgcttcaccggcgagcggaacaaccagatcctggaggagaacatggaggtggagatctggacccgcgagggggagaagaagaagctgcggccccgctggctcgacgcccgggtctacgcggaccccatggccctgaaggacttcaaggagttcgcctccggccgcaagagcatcaccctggacatcctcaccgagatcgcctccctgccgacgtacctgagcagccgcgccaagctcgcgctggacaacatcgtgatgctgcacaccaccgagcggggcgggcgcgcctaccagcacgccctcaacgagctgcccgagtccctggagaccctcatgctggtggccctgctcggcgcgatgacggccgggatcttcctgttcttcatgcagggcaaggggatcggcaagctgagcatgggcctcatcaccatcgccgtcgcctccgggctgctgtgggtggccgagatccagccccagtggatcgcggccagcatcatcctcgagttcttcctgatggtgctgctcatcccggagcccgagaagcagcggaccccccaggacaaccagctgatctacgtcatcctgaccatcctcacgatcatcggcctgatcgccgccaacgagatggggctgatcgagaagaccaagaccgacttcggcttctaccaggccaagaccgagacgaccatcctcgacgtggacctgcgccccgcgtccgcctggaccctgtacgccgtggccaccacgatcctcaccccgatgctgcggcacaccatcgagaacaccagcgccaacctgtccctcgcggccatcgccaaccaggccgccgtcctgatggggctgggcaagggctggcccctccaccgcatggacctgggggtgcccctgctcgcgatgggctgctacagccaggtgaaccccacgaccctgaccgcctccctggtcatgctcctggtgcactacgccatcatcgggccgggcctgcaggccaaggcgacccgggaggcccagaagcgcacggccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggaccacgtgggcgttctgcgaggtcctgaccctcgccaccggcccgatcctgaccctgtgggaggggaaccccggccgcttctggaacacgaccatcgccgtgtccaccgccaacatcttccggggcagctacctcgccggggcgggcctggccttctccctgatcaagaacgcccagaccccccgccgggggacgggcaccatcggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggagctactacatggccaccctcaagaacgtgacggaggtcaagggctacaccaaggggggcccggggcacgaggagcccatccccatggccacctacggctggaacctggtgaagctgcactccggcgtggacgtcttctaccggcccaccgagcaggtggacacgctcctgtgcgacatcggggagagctccagcaacccgaccatcgaggagggccgcaccctgcgggtgctcaagatggtcgagccctggctgtccagcaagcccgagttctgcatcaaggtgctgaacccctacatgccgaccgtgatcgaggagctggagaagctccagcgcaagcacgggggcaacctggtccggtgccccctgtcccgcaacagcacgcacgagatgtactgggtgtccggcgccagcgggaacatcgtctccagcgtgaacaccacctccaagatgctcctgaaccggttcaccacgcgccaccggaagcccacctacgagaaggacgtggacctgggcgcggggacccgcagcgtctccaccgagacggagaagcccgacatgaccatcatcggccggcgcctccagcggctgcaggaggagcacaaggagacctggcactacgaccaggagaacccgtaccgcacctgggcctaccacgggagctacgaggccccctccacgggcagcgcctccagcatggtgaacggcgtggtcaagctgctcaccaagccctgggacgtgatcccgatggtgacccagctggccatgaccgacacgacccccttcgggcagcagcgggtcttcaaggagaaggtggacacccgcaccccccagcccaagccgggcacgcggatggtgatgaccaccaccgcgaactggctgtgggccctcctggggaagaagaagaacccccgcctgtgcacgcgggaggagttcatcagcaaggtccgctccaacgccgccatcggcgccgtgttccaggaggagcaggggtggaccagcgcgtccgaggccgtgaacgacagccggttctgggagctcgtcgacaaggagcgcgccctgcaccaggagggcaagtgcgagtcctgcgtgtacaacatgatgggcaagcgcgagaagaagctgggggagttcggccgggccaaggggagccgcgccatctggtacatgtggctcggcgcgcggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgccgacgacaccgccggctgggacacccgcatcacggaggacgacctgcagaacgaggagctcatcaccgagcagatggcgccccaccacaagatcctggccaaggccatcttcaagctgacctaccagaacaaggtcgtgaaggtgctccggcccaccccgcgcggggccgtcatggacatcatctcccggaaggaccagcgcggcagcgggcaggtgggcacctacgggctgaacacgttcaccaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggcgatctccggcgacgactgcgtcgtgaagcccctcgacgagcgcttcgggaccagcctgctgttcctcaacgacatgggcaaggtgcggaaggacatcccccagtgggagccgtccaaggggtggaagaactggcaggaggtccccttctgcagccaccacttccacaagatcttcatgaaggacggccgctccctggtggtgccctgccggaaccaggacgagctgatcggccgcgcccgcatcagccagggggccggctggtccctccgggagacggcctgcctggggaaggcctacgcgcagatgtggagcctgatgtacttccaccgccgggacctccgcctggccagcatggccatctgctccgccgtccccaccgagtggttcccgaccagccggaccacgtggtccatccacgcccaccaccagtggatgaccaccgaggacatgctgaaggtgtggaaccgcgtgtggatcgaggacaaccccaacatgatcgacaagacccccgtccacagctgggaggacatcccctacctcggcaagcgggaggacctgtggtgcgggtccctgatcggcctcagctcccgcgcgacgtgggccaagaacatccacaccgccatcacccaggtgcggaacctgatcggcaaggaggagtacgtggactacatgccggtcatgaagcgctacagcgccccctccgagagcgagggggtgctgtga

SEQ ID NO: 10438 - RNA, 9867 nt, synthetic construct
  misc_feature 1..9867: note = derived and/or modified CDS sequence (opt1) from DENV-4__GQ199878__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctctccgagaaggaggagaacatggtgaagagccaggtcgccgccggccagggcacgtccgagaccttcagcatggggctgctgtgcctcaccctgttcgtggaggagtgcctgcggcgccgggtgacccgcaagcacatgatcctcgcggtcgtgatcacgctgtgcgccatcatcctgggcgggctcacctggatggacctgctgcgggccctcatcatgctgggcgacaccatgtccggccgcatcgggggccagacccacctggccatcatggccgtgttcaagatgagccccgggtacgtcctcggcgtgttcctgcggaagctgacgtcccgcgagaccgcgctcatggtgatcgggatggccatgaccaccacgctgagcatcccgcacgacctgatggagctcatcgacggcatctccctgggcctgatcctcctgaagatcgtcacccagttcgacaacacccaggtggggaccctggccctcagcctgacgttcatccggtccaccatgagcctggtgatggcctggcgcaccatcatggccgtcctcttcgtggtgaccctgatccccctgtgccggacgtcctgcctccagaagcagagccactgggtcgagatcaccgcgctgatcctgggcgcccaggccctccccgtgtacctgatgaccctgatgaagggggcctcccgccggagctggcccctcaacgagggcatcatggcggtggggctggtctccctgctcggcagcgccctgctgaagaacgacgtgccgctcgccggccccatggtggccgggggcctgctgctcgccgcgtacgtcatgagcgggtccagcgccgacctgtccctggagaaggccgccaacgtgcagtgggacgagatggccgacatcaccggcagctcccccatcatcgaggtgaagcaggacgaggacgggagcttctccatccgcgacgtcgaggagacgaacatgatcaccctcctggtgaagctggcgctcatcaccgtgagcggcctgtaccccctggccatcccggtcaccatgacgctctggtacatgtggcaggtgaagacccagcggtccggcgccctgtgggacgtgcccagccccgccgccacccagaaggcggccctgtccgagggggtctaccgcatcatgcagcggggcctcttcgggaagacccaggtgggcgtggggatccacatggagggcgtcttccacaccatgtggcacgtgacgcgcggcagcgtgatctgccacgagaccgggcggctggagccctcctgggccgacgtccgcaacgacatgatcagctacggcgggggctggcgcctgggcgacaagtgggacaaggaggaggacgtgcaggtgctcgccatcgagccggggaagaaccccaagcacgtccagaccaagcccggcctgttcaagaccctgacgggggagatcggcgccgtgaccctcgacttcaagcccgggacctccggcagcccgatcatcaaccggaagggcaaggtgatcgggctgtacggcaacggggtcgtgaccaagtccggcgactacgtgagcgcgatcacgcaggccgagcgcatcggggagcccgactacgaggtcgacgaggacatcttccggaagaagcgcctgaccatcatggacctccaccccggcgccggcaagaccaagcggatcctgccgtccatcgtgcgcgaggccctgaagcggcgcctgcggaccctcatcctggcgcccacgcgcgtggtcgccgccgagatggaggaggccctgcgggggctccccatccgctaccagacccccgccgtgaagagcgagcacaccggccgggagatcgtggacctgatgtgccacgcgaccttcacgacccgcctgctcagctccacccgggtcccgaactacaacctgatcgtgatggacgaggcccacttcaccgaccccagctccgtcgccgcccgcgggtacatcagcacgcgggtggagatgggcgaggccgcggccatcttcatgaccgccaccccccccggggccaccgacccgttcccccagtccaacagccccatcgaggacatcgagcgcgagatccccgagcggtcctggaacacgggcttcgactggatcaccgactaccagggcaagaccgtgtggttcgtcccgagcatcaaggccgggaacgacatcgcgaactgcctgcgcaagtccggcaagaaggtgatccagctcagccgcaagaccttcgacacggagtaccccaagaccaagctgaccgactgggacttcgtggtcaccacggacatctccgagatgggggccaacttccgggccggccgcgtgatcgacccccggcgctgcctgaagcccgtgatcctcaccgacgggccggagcgggtcatcctggccggccccatccccgtgacccccgcgagcgccgcccagcgccggggccgcatcgggcggaacccggcccaggaggacgaccagtacgtgttctccggcgaccccctgaagaacgacgaggaccacgcccactggaccgaggcgaagatgctcctggacaacatctacacgcccgaggggatcatccccaccctgttcggcccggagcgcgagaagacccaggccatcgacggcgagttccggctccgcggggagcagcggaagaccttcgtcgagctgatgcgccggggcgacctgcccgtgtggctcagctacaaggtggcctccgccgggatcagctacaaggaccgcgagtggtgcttcacgggcgagcggaacaaccagatcctggaggagaacatggaggtcgagatctggacccgcgagggggagaagaagaagctgcggccccgctggctcgacgcccgggtgtacgcggaccccatggccctgaaggacttcaaggagttcgcctccggccgcaagagcatcaccctggacatcctcaccgagatcgcctccctgccgacctacctgagcagccgcgccaagctcgcgctggacaacatcgtgatgctgcacacgaccgagcggggcgggcgcgcctaccagcacgccctcaacgagctgcccgagtccctggagaccctcatgctggtcgccctgctcggcgcgatgaccgccgggatcttcctgttcttcatgcagggcaaggggatcggcaagctgagcatgggcctcatcacgatcgccgtggcctccgggctgctgtgggtggccgagatccagccccagtggatcgcggccagcatcatcctcgagttcttcctgatggtcctgctcatcccggagcccgagaagcagcggaccccccaggacaaccagctgatctacgtgatcctgaccatcctcaccatcatcggcctgatcgccgccaacgagatggggctgatcgagaagacgaagaccgacttcggcttctaccaggtgaagaccgagaccacgatcctcgacgtcgacctgcgccccgcctccgcgtggaccctgtacgccgtggccaccaccatcctcacgccgatgctgcggcacaccatcgagaacaccagcgccaacctgtccctcgccgcgatcgccaaccaggccgccgtgctgatggggctgggcaagggctggcccctccaccgcatggacctgggggtccccctgctcgccatgggctgctacagccaggtgaaccccaccacgctgaccgcgtccctggtgatgctcctggtccactacgccatcatcgggccgggcctgcaggccaaggccacccgggaggcgcagaagcgcaccgccgccggcatcatgaagaaccccacggtggacgggatcaccgtgatcgacctcgagcccatcagctacgaccccaagttcgagaagcagctgggccaggtcatgctgctcgtgctgtgcgccgggcagctgctcctgatgcggaccacctgggccttctgcgaggtgctgacgctcgcgaccggcccgatcctgaccctgtgggaggggaaccccggccgcttctggaacaccacgatcgccgtctccaccgccaacatcttccggggcagctacctcgccggggccggcctggcgttctccctgatcaagaacgcccagaccccccgccgggggaccggcacgaccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgccgtgagccgcggctccagcaagatccggtggatcgtcgagcgcgggatggtgaagcccaagggcaaggtggtcgacctggggtgcggccgcggcgggtggagctactacatggcgaccctcaagaacgtgacggaggtgaagggctacaccaaggggggcccggggcacgaggagcccatccccatggccacctacggctggaacctggtcaagctgcactccggcgtggacgtgttctacaagcccaccgagcaggtcgacacgctcctgtgcgacatcggggagagctccagcaacccgaccatcgaggagggccggaccctgcgcgtgctcaagatggtggagccctggctgtccagcaagcccgagttctgcatcaaggtcctgaacccctacatgccgaccgtgatcgaggagctggagaagctccagcggaagcacgggggcaacctggtccgctgccccctgtcccggaacagcacgcacgagatgtactgggtgtccggcgccagcgggaacatcgtgtccagcgtcaacaccacctccaagatgctcctgaaccgcttcaccacgcggcaccgcaagcccacctacgagaaggacgtggacctgggcgccgggacccggagcgtgtccaccgagacggagaagcccgacatgaccatcatcggccgccggctccagcgcctgcaggaggagcacaaggagacctggcactacgaccaggagaacccgtaccggacctgggcgtaccacgggagctacgaggccccctccacgggcagcgcctccagcatggtcaacggcgtggtgaagctgctcaccaagccctgggacgtcatcccgatggtgacccagctggccatgaccgacacgacccccttcgggcagcagcgcgtgttcaaggagaaggtcgacacccggaccccccagcccaagccgggcacgcgcatggtgatgaccaccaccgccaactggctgtgggcgctcctggggaagaagaagaacccccggctgtgcacgcgcgaggagttcatcagcaaggtgcggtccaacgccgccatcggcgccgtcttccaggaggagcaggggtggaccagcgcctccgaggcggtgaacgacagccgcttctgggagctcgtggacaaggagcgggccctgcaccaggagggcaagtgcgagtcctgcgtctacaacatgatgggcaagcgcgagaagaagctgggggagttcggccgcgccaaggggagccgggccatctggtacatgtggctcggcgcccgcttcctggagttcgaggcgctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggccccccaccacaagatcctggcgaaggccatcttcaagctgacctaccagaacaaggtggtcaaggtgctccgccccaccccgcggggggccgtgatggacatcatctcccgcaaggaccagcggggcagcgggcaggtcggcacctacgggctgaacacgttcaccaacatggaggtgcagctgatccgccagatggaggccgagggcgtgatcacccaggacgacatgcagaaccccaagggcctcaaggagcgggtcgagaagtggctgcgcgagtgcggggtggaccggctgaagcgcatggccatctccggcgacgactgcgtggtcaagcccctcgacgagcggttcgggaccagcctgctgttcctcaacgacatgggcaaggtgcgcaaggacatcccccagtgggagccgtccaaggggtggaagaactggcaggaggtgcccttctgcagccaccacttccacaagatcttcatgaaggacggccggtccctggtcgtgccctgccgcaaccaggacgagctgatcggccgggcgcgcatcagccagggggccggctggtccctccgcgagacggcctgcctggggaaggcctacgcccagatgtggagcctgatgtacttccaccggcgcgacctccggctggcgagcatggccatctgctccgccgtgcccaccgagtggttcccgaccagccgcaccacgtggtccatccacgcccaccaccagtggatgaccaccgaggacatgctgaaggtctggaaccgggtgtggatcgaggacaaccccaacatgatcgacaagacccccgtgcacagctgggaggacatcccctacctcggcaagcgcgaggacctgtggtgcgggtccctgatcggcctcagctcccgggccacgtgggcgaagaacatccacaccgccatcacccaggtccgcaacctgatcggcaaggaggagtacgtggactacatgccggtgatgaagcggtacagcgccccctccgagagcgagggggtcctgtga

SEQ ID NO: 10439 - RNA, 9867 nt, synthetic construct
  misc_feature 1..9867: note = derived and/or modified CDS sequence (opt1) from DENV-4__GQ199879__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatggtgcgcatcctgatcgggttcctcgtgctgtggatcggcacgaactcccggaacaccagcatggccatgacctgcatcgccgtcggcgggatcaccctgttcctgggcttcacggtgcaggccgacatggggtgcgtggtctcctggagcggccgcgagctcaagtgcgggagcggcatcttcgtggtggacaacgtccacacctggaccgagcagtacaagttccagcccgagtcccccgcgcggctggccagcgccatcctgaacgcccacaaggacggcgtgtgcgggatccgctccaccacgcggctcgagaacgtgatgtggaagcagatcaccaacgagctgaactacgtcctgtgggagggcgggcacgacctcaccgtggtggccggcgacgtcaagggcgtgctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtcgaggactacggcttcgggatgttcaccaccaacatctggatgaagttccgcgagggctccagcgaggtgtgcgaccaccggctcatgtccgccgcgatcaaggaccagaaggccgtgcacgccgacatgggctactggatcgagagctccaagaaccagacctggcagatcgagaaggccagcctgatcgaggtcaagacgtgcctgtggcccaagacccacaccctctggtccaacggggtgctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtcaccatccaggaggactgcgaccaccgggggcccagcctgcgcaccacgaccgcctccggcaagctcgtgacccagtggtgctgccgcagctgcaccatgccgcccctgcggttcctgggggaggacggctgctggtacgggatggagatccgccccctcaacgagaaggaggagaacatggtcaagtcccaggtgacggccggccagggcaccagcgagaccttctccatggggctgctgtgcctcaccctgttcgtggaggagtgcctgcggcgccgggtcacgcgcaagcacatgatcctcgtggtggtcatcaccctgtgcgccatcatcctgggcgggctcacctggatggacctgctgcgggcgctcatcatgctgggcgacaccatgagcggccgcatcgggggccagatccacctggccatcatggccgtgttcaagatgtcccccgggtacgtgctcggcgtcttcctgcggaagctgacgagccgcgagaccgccctcatggtgatcgggatggccatgaccaccgtgctgtccatcccgcacgacctgatggagctcatcgacggcatcagcctgggcctgatcctcctgaagatcgtcacgcagttcgacaacacccaggtggggaccctggcgctctccctgaccttcatccggagcacgatgcccctggtgatggcctggcgcaccatcatggccgtcctcttcgtggtgaccctgatccccctgtgccggacctcctgcctccagaagcagagccactgggtcgagatcacggccctgatcctgggcgcccaggcgctccccgtgtacctgatgaccctgatgaagggggcctcccgccggagctggccgctcaacgagggcatcatggccgtggggctggtctccctgctcggcagcgccctgctgaagaacgacgtgcccctcgcgggccccatggtggccgggggcctgctgctcgccgcctacgtcatgtccgggagcagcgccgacctgtccctggagaaggcggccaacgtgcagtgggacgagatggccgacatcaccggcagctcccccatcatcgaggtgaagcaggacgaggacgggagcttctccatccgcgacgtcgaggagaccaacatgatcacgctcctggtgaagctggccctcatcaccgtgagcggcctgtacccgctggccatccccgtcaccatgaccctctggtacatgtggcaggtgaagacgcagcggtccggcgcgctgtgggacgtgcccagccccgccgccacccagaaggccgccctgtccgagggggtctaccgcatcatgcagcggggcctcttcgggaagacccaggtgggcgtggggatccacatggagggcgtcttccacaccatgtggcacgtgacccgcggcagcgtgatctgccacgagacggggcggctggagccgtcctgggcggacgtccgcaacgacatgatcagctacggcgggggctggcgcctgggcgacaagtgggacaaggaggaggacgtgcaggtgctcgccatcgagcccgggaagaaccccaagcacgtccagaccaagcccggcctgttcaagaccctgaccggggagatcggcgccgtgacgctcgacttcaagccggggacctccggcagccccatcatcaaccggaagggcaaggtgatcgggctgtacggcaacggggtcgtgaccaagtccggcgactacgtgagcgccatcacccaggccgagcgcatcggggagcccgactacgaggtcgacgaggacatcttccggaagaagcgcctgacgatcatggacctccacccgggcgcgggcaagaccaagcggatcctgccctccatcgtgcgcgaggccctgaagcggcgcctgcggaccctcatcctggcccccacccgcgtggtcgccgcggagatggaggaggccctgcgggggctccccatccgctaccagacgccggccgtgaagagcgagcacaccggccgggagatcgtcgacctgatgtgccacgccaccttcaccacgcgcctgctctccagcacccgggtgcccaactacaacctgatcgtgatggacgaggcccacttcaccgaccccagctccgtcgcggcccgcgggtacatcagcacccgggtggagatgggcgaggccgccgccatcttcatgacggcgacccccccgggggccaccgaccccttcccccagtccaacagccccatcgaggacatcgagcgcgagatcccggagcggtcctggaacaccggcttcgactggatcacggactaccagggcaagaccgtgtggttcgtccccagcatcaaggccgggaacgacatcgccaactgcctgcgcaagtccggcaagaaggtgatccagctcagccgcaagaccttcgacaccgagtaccccaagacgaagctgaccgactgggacttcgtggtcaccaccgacatctccgagatgggggccaacttccgggcgggccgcgtgatcgacccccggcgctgcctgaagccggtgatcctcacggacgggcccgagcgggtcatcctggccggccccatccccgtgaccccggccagcgccgcgcagcgccggggccgcatcgggcggaaccccgcccaggaggacgaccagtacgtgttctccggcgaccccctgaagaacgacgaggaccacgcccactggaccgaggccaagatgctcctggacaacatctacacccccgaggggatcatcccgacgctgttcggccccgagcgcgagaagacccaggccatcgacggcgagttccggctccgcggggagcagcggaagaccttcgtcgagctgatgcgccggggcgacctgcccgtgtggctcagctacaaggtggcgtccgccgggatcagctacaaggaccgcgagtggtgcttcaccggcgagcggaacaaccagatcctggaggagaacatggaggtcgagatctggacgcgcgagggggagaagaagaagctgcggccccgctggctcgacgcccgggtgtacgccgacccgatggccctgaaggacttcaaggagttcgcgtccggccgcaagagcatcaccctggacatcctcaccgagatcgcctccctgcccacctacctgagctcccgcgccaagctcgccctggacaacatcgtgatgctgcacaccacggagcggggcgggcgcgcctaccagcacgcgctcaacgagctgcccgagagcctggagaccctcatgctggtcgccctgctcggcgccatgaccgccgggatcttcctgttcttcatgcagggcaaggggatcggcaagctgagcatgggcctcatcgcgatcgccgtggcctccgggctgctgtgggtggccgagatccagccgcagtggatcgccgcgagcatcatcctcgagttcttcctgatggtcctgctcatccccgagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtgaagacggagaccaccatcctcgacgtcgacctgcgcccggcctccgcctggaccctgtacgcggtggccacgaccatcctcacccccatgctgcggcacaccatcgagaacacgagcgccaacctgtccctcgccgccatcgcgaaccaggccgccgtgctgatggggctgggcaagggctggcccctccaccgcatggacctgggggtccccctgctcgccatgggctgctacagccaggtgaacccgaccaccctgaccgcctccctggtgatgctcctggtccactacgcgatcatcgggcccggcctgcaggccaaggccacgcgggaggcccagaagcgcaccgcggccggcatcatgaagaaccccaccgtggacgggatcaccgtgatcgacctcgagcccatcagctacgacccgaagttcgagaagcagctgggccaggtcatgctgctcgtgctgtgcgccgggcagctgctcctgatgcggacgacctgggccttctgcgaggtgctgaccctcgccaccggccccatcctgacgctgtgggaggggaaccccggccgcttctggaacaccaccatcgcggtctccaccgccaacatcttccggggcagctacctcgccggggccggcctggccttctccctgatcaagaacgcgcagacgccccgccgggggaccggcaccaccggggagacgctcggcgagaagtggaagcgccagctgaacagcctggaccggaaggagttcgaggagtacaagcgctccggcatcctcgaggtggaccggaccgaggccaagagcgccctgaaggacgggtccaagaccaagcacgccgtgagccgcggctccagcaagatccggtggatcgtcgagcgcgggatggtgaagccgaagggcaaggtggtcgacctggggtgcggccgcggcgggtggtcctactacatggccaccctcaagaacgtgaccgaggtgaagggctacacgaaggggggccccgggcacgaggagcccatccccatggcgacctacggctggaacctggtcaagctgcacagcggcgtggacgtgttctacaagccgaccgagcaggtcgacaccctcctgtgcgacatcggggagagctccagcaaccccacgatcgaggagggccggaccctgcgcgtgctcaagatggtcgagccctggctgtccagcaagcccgagttctgcatcaaggtgctgaacccgtacatgcccaccgtgatcgaggagctggagaagctccagcggaagcacgggggcaacctggtccgctgccccctgtcccggaacagcacccacgagatgtactgggtgtccggcgccagcgggaacatcgtgtccagcgtcaacacgacctccaagatgctcctgaaccgcttcaccacccggcaccgcaagcccacgtacgagaaggacgtggacctgggcgccgggacccggagcgtgtccaccgagaccgagaagccggacatgacgatcatcggccgccggctccagcgcctgcaggaggagcacaaggagacctggcactacgaccaggagaacccctaccggacctgggcctaccacgggagctacgaggcgccctccaccggcagcgcctccagcatggtcaacggcgtggtgaagctgctcacgaagccgtgggacgtcatccccatggtgacccagctggccatgaccgacaccacgcccttcgggcagcagcgcgtgttcaaggagaaggtcgacacccggaccccccagccgaagcccggcacccgcatgatcatgacgaccaccgccaactggctgtgggccctcctggggaagaagaagaacccccggctgtgcacccgcgaggagttcatctccaaggtgcggagcaacgcggccatcggcgccgtgttccaggaggagcaggggtggacgagcgcctccgaggccgtcaacgacagccgcttctgggagctcgtggacaaggagcgggcgctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgcggacgacaccgccggctgggacacccggatcaccgaggacgacctgcagaacgaggagctcatcacggagcagatggccccccaccacaagatcctggccaaggcgatcttcaagctgacctaccagaacaaggtggtgaaggtcctccgcccgaccccccggggggccgtgatggacatcatctcccgcaaggaccagcggggcagcgggcaggtgggcacctacgggctgaacaccttcacgaacatggaggtccagctgatccgccagatggaggccgagggcgtgatcacccaggacgacatgcagaaccccaagggcctcaaggagcgggtggagaagtggctgcgcgagtgcggggtcgaccggctgaagcgcatggccatctccggcgacgactgcgtggtgaagcccctcgacgagcggttcgggaccagcctgctgttcctcaacgacatgggcaaggtccgcaaggacatcccgcagtgggagccctccaaggggtggaagaactggcaggaggtgcccttctgcagccaccacttccacaagatcttcatgaaggacggccggtccctggtggtcccctgccgcaaccaggacgagctgatcggccgggcccgcatcagccagggggcgggctggtccctccgcgagaccgcctgcctggggaaggcctacgcccagatgtggagcctgatgtacttccaccggcgcgacctccggctggcctccatggcgatctgcagcgccgtgccgacggagtggttccccaccagccgcaccacctggtccatccacgcccaccaccagtggatgacgaccgaggacatgctgaaggtgtggaaccgggtctggatcgaggacaaccccaacatgaccgacaagacccccatccacagctgggaggacatcccgtacctcggcaagcgcgaggacctgtggtgcgggtccctgatcggcctcagctcccgggccacgtgggccaagaacatccacaccgcgatcacccaggtgcgcaacctgatcggcaaggaggagtacgtggactacatgcccgtcatgaagcggtacagcgccccctccgagagcgagggggtgctgtga

SEQ ID NO: 10440 - RNA, 9867 nt, synthetic construct
  misc_feature 1..9867: note = derived and/or modified CDS sequence (opt1) from DENV-4__GQ199880__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctcaacgagaaggaggagaacatggtgaagtcccaggtcacggccggccagggcaccagcgagaccttctccatggggctgctgtgcctcaccctgttcgtggaggagtgcctgcggcgccgggtgacgcgcaagcacatgatcctcgtcgtggtgatcaccctgtgcgccatcatcctgggcgggctcacctggatggacctgctgcgggcgctcatcatgctgggcgacaccatgagcggccgcatcgggggccagatccacctggccatcatggccgtcttcaagatgtcccccgggtacgtgctcggcgtgttcctgcggaagctgacgagccgcgagaccgccctcatggtcatcgggatggccatgaccaccgtgctgtccatcccgcacgacctgatggagctcatcgacggcatcagcctgggcctgatcctcctgaagatcgtgacgcagttcgacaacacccaggtcgggaccctggcgctctccctgaccttcatccggagcacgatgcccctggtgatggcctggcgcaccatcatggccgtgctcttcgtcgtgaccctgatccccctgtgccggacctcctgcctccagaagcagagccactgggtggagatcacggccctgatcctgggcgcccaggcgctccccgtctacctgatgaccctgatgaagggggcctcccgccggagctggccgctcaacgagggcatcatggccgtggggctggtgtccctgctcggcagcgccctgctgaagaacgacgtccccctcgcgggccccatggtggccgggggcctgctgctcgccgcctacgtgatgtccgggagcagcgccgacctgtccctggagaaggcggccaacgtccagtgggacgagatggccgacatcaccggcagctcccccatcatcgaggtgaagcaggacgaggacgggagcttctccatccgcgacgtggaggagaccaacatgatcacgctcctggtcaagctggccctcatcaccgtgagcggcctgtacccgctggccatccccgtgaccatgaccctctggtacatgtggcaggtcaagacgcagcggtccggcgcgctgtgggacgtgcccagccccgccgccacccagaaggccgccctgtccgagggggtgtaccgcatcatgcagcggggcctcttcgggaagacccaggtcggcgtggggatccacatggagggcgtgttccacaccatgtggcacgtcacccgcggcagcgtgatctgccacgagacggggcggctggagccgtcctgggcggacgtgcgcaacgacatgatcagctacggcgggggctggcgcctgggcgacaagtgggacaaggaggaggacgtccaggtgctcgccatcgagcccgggaagaaccccaagcacgtgcagaccaagcccggcctgttcaagaccctgaccggggagatcggcgccgtcacgctcgacttcaagccggggacctccggcagccccatcatcaaccggaagggcaaggtgatcgggctgtacggcaacggggtggtcaccaagtccggcgactacgtgagcgccatcacccaggccgagcgcatcggggagcccgactacgaggtggacgaggacatcttccggaagaagcgcctgacgatcatggacctccacccgggcgcgggcaagaccaagcggatcctgccctccatcgtccgcgaggccctgaagcggcgcctgcggaccctcatcctggcccccacccgcgtggtggccgcggagatggaggaggccctgcgggggctccccatccgctaccagacgccggccgtcaagagcgagcacaccggccgggagatcgtggacctgatgtgccacgccaccttcaccacgcgcctgctctccagcacccgggtccccaactacaacctgatcgtgatggacgaggcccacttcaccgaccccagctccgtggcggcccgcgggtacatcagcacccgggtcgagatgggcgaggccgccgccatcttcatgacggcgacccccccgggggccaccgaccccttcccccagtccaacagccccatcgaggacatcgagcgcgagatcccggagcggtcctggaacaccggcttcgactggatcacggactaccagggcaagaccgtgtggttcgtgcccagcatcaaggccgggaacgacatcgccaactgcctgcgcaagtccggcaagaaggtcatccagctcagccgcaagaccttcgacaccgagtaccccaagacgaagctgaccgactgggacttcgtggtgaccaccgacatctccgagatgggggccaacttccgggcgggccgcgtcatcgacccccggcgctgcctgaagccggtgatcctcacggacgggcccgagcgggtgatcctggccggccccatccccgtcaccccggccagcgccgcgcagcgccggggccgcatcgggcggaaccccgcccaggaggacgaccagtacgtgttctccggcgaccccctgaagaacgacgaggaccacgcccactggaccgaggccaagatgctcctggacaacatctacacccccgaggggatcatcccgacgctgttcggccccgagcgcgagaagacccaggccatcgacggcgagttccggctccgcggggagcagcggaagaccttcgtggagctgatgcgccggggcgacctgcccgtctggctcagctacaaggtggcgtccgccgggatcagctacaaggaccgcgagtggtgcttcaccggcgagcggaacaaccagatcctggaggagaacatggaggtggagatctggacgcgcgagggggagaagaagaagctgcggccccgctggctcgacgcccgggtctacgccgacccgatggccctgaaggacttcaaggagttcgcgtccggccgcaagagcatcaccctggacatcctcaccgagatcgcctccctgcccacctacctgagctcccgcgccaagctcgccctggacaacatcgtgatgctgcacaccacggagcggggcgggcgcgcctaccagcacgcgctcaacgagctgcccgagagcctggagaccctcatgctggtggccctgctcggcgccatgaccgccgggatcttcctgttcttcatgcagggcaaggggatcggcaagctgagcatgggcctcatcgcgatcgccgtcgcctccgggctgctgtgggtggccgagatccagccgcagtggatcgccgcgagcatcatcctcgagttcttcctgatggtgctgctcatccccgagcccgagaagcagcggaccccccaggacaaccagctgatctacgtcatcctgacgatcctcaccatcatcggcctgatcgccgccaacgagatggggctgatcgagaagaccaagaccgacttcggcttctaccaggtgaagacggagaccaccatcctcgacgtggacctgcgcccggcctccgcctggaccctgtacgcggtcgccacgaccatcctcacccccatgctgcggcacaccatcgagaacacgagcgccaacctgtccctcgccgccatcgcgaaccaggccgccgtgctgatggggctgggcaagggctggcccctccaccgcatggacctgggggtgcccctgctcgccatgggctgctacagccaggtcaacccgaccaccctgaccgcctccctggtgatgctcctggtgcactacgcgatcatcgggcccggcctgcaggccaaggccacgcgggaggcccagaagcgcaccgcggccggcatcatgaagaaccccaccgtcgacgggatcaccgtgatcgacctcgagcccatcagctacgacccgaagttcgagaagcagctgggccaggtgatgctgctcgtcctgtgcgccgggcagctgctcctgatgcggacgacctgggccttctgcgaggtgctgaccctcgccaccggccccatcctgacgctgtgggaggggaaccccggccgcttctggaacaccaccatcgcggtgtccaccgccaacatcttccggggcagctacctcgccggggccggcctggccttctccctgatcaagaacgcgcagacgccccgccgggggaccggcaccaccggggagacgctcggcgagaagtggaagcgccagctgaacagcctggaccggaaggagttcgaggagtacaagcgctccggcatcctcgaggtcgaccggaccgaggccaagagcgccctgaaggacgggtccaagaccaagcacgccgtgagccgcggctccagcaagatccggtggatcgtggagcgcgggatggtcaagccgaagggcaaggtggtggacctggggtgcggccgcggcgggtggtcctactacatggccaccctcaagaacgtcaccgaggtgaagggctacacgaaggggggccccgggcacgaggagcccatccccatggcgacctacggctggaacctggtgaagctgcacagcggcgtcgacgtgttctacaagccgaccgagcaggtggacaccctcctgtgcgacatcggggagagctccagcaaccccacgatcgaggagggccggaccctgcgcgtcctcaagatggtggagccctggctgtccagcaagcccgagttctgcatcaaggtcctgaacccgtacatgcccaccgtgatcgaggagctggagaagctccagcggaagcacgggggcaacctggtgcgctgccccctgtcccggaacagcacccacgagatgtactgggtctccggcgccagcgggaacatcgtgtccagcgtgaacacgacctccaagatgctcctgaaccgcttcaccacccggcaccgcaagcccacgtacgagaaggacgtcgacctgggcgccgggacccggagcgtgtccaccgagaccgagaagccggacatgacgatcatcggccgccggctccagcgcctgcaggaggagcacaaggagacctggcactacgaccaggagaacccctaccggacctgggcctaccacgggagctacgaggcgccctccaccggcagcgcctccagcatggtgaacggcgtcgtgaagctgctcacgaagccgtgggacgtgatccccatggtcacccagctggccatgaccgacaccacgcccttcgggcagcagcgcgtgttcaaggagaaggtggacacccggaccccccagccgaagcccggcacccgcatgatcatgacgaccaccgccaactggctgtgggccctcctggggaagaagaagaacccccggctgtgcacccgcgaggagttcatctccaaggtccggagcaacgcggccatcggcgccgtgttccaggaggagcaggggtggacgagcgcctccgaggccgtgaacgacagccgcttctgggagctcgtcgacaaggagcgggcgctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgcggacgacaccgccggctgggacacccggatcaccgaggacgacctgcagaacgaggagctcatcacggagcagatggccccccaccacaagatcctggccaaggcgatcttcaagctgacctaccagaacaaggtcgtgaaggtgctccgcccgaccccccggggggccgtcatggacatcatctcccgcaaggaccagcggggcagcgggcaggtgggcacctacgggctgaacaccttcacgaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggccatctccggcgacgactgcgtcgtgaagcccctcgacgagcggttcgggaccagcctgctgttcctcaacgacatgggcaaggtgcgcaaggacatcccgcagtgggagccctccaaggggtggaagaactggcaggaggtccccttctgcagccaccacttccacaagatcttcatgaaggacggccggtccctggtggtgccctgccgcaaccaggacgagctgatcggccgggcccgcatcagccagggggcgggctggtccctccgcgagaccgcctgcctggggaaggcctacgcccagatgtggagcctgatgtacttccaccggcgcgacctccggctggcctccatggcgatctgcagcgccgtcccgacggagtggttccccaccagccgcaccacctggtccatccacgcccaccaccagtggatgacgaccgaggacatgctgaaggtgtggaaccgggtgtggatcgaggacaaccccaacatgaccgacaagacccccatccacagctgggaggacatcccgtacctcggcaagcgcgaggacctgtggtgcgggtccctgatcggcctcagctcccgggccacgtgggccaagaacatccacaccgcgatcacccaggtccgcaacctgatcggcaaggaggagtacgtggactacatgcccgtgatgaagcggtacagcgccccctccgagagcgagggggtcctgtga

SEQ ID NO: 10441 - RNA, 9867 nt, synthetic construct
  misc_feature 1..9867: note = derived and/or modified CDS sequence (opt1) from DENV-4__GQ252675__SS-prME
  source 1..9867: mol_type = other RNA
agcaccatcaccctgctctgcctgatccccaccgtgatggccttccacctgtccacccgggacggcgagccgctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcaccgtgttcttcgtgctgatgatgctggtggccccctcctacggcatgcggtgcgtgggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaagatccgcatggagaagctccgcatcaagggcatgagctacaccatgtgctccggcaagttcagcatcgacaaggagatggccgagacgcagcacgggaccaccgtggtcaaggtgaagtacgagggcgccggggccccctgcaaggtgcccatcgagatccgggacgtcaacaaggagaaggtggtgggccgcgtcatctccagcacgcccctggcggagaacacgaactccgtgaccaacatcgagctggagccgcccttcggggacagctacatcgtgatcggcgtcggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtgcaccaggtcttcggctccgtgtacaccaccatgttcgggggcgtgagctggatgatccgcatcctgatcgggttcctcgtcctgtggatcggcacgaactcccggaacaccagcatggccatgacctgcatcgccgtgggcgggatcaccctgttcctgggcttcacggtgcaggccgacatggggtgcgtcgtgtcctggagcggccgcgagctcaagtgcgggagcggcatcttcgtggtcgacaacgtgcacacctggaccgagcagtacaagttccagcccgagtcccccgcgcggctggccagcgccatcctgaacgcccacaaggacggcgtgtgcgggatccgctccaccacgcggctcgagaacgtcatgtggaagcagatcaccaacgagctgaactacgtgctgtgggagggcgggcacgacctcaccgtggtcgccggcgacgtgaagggcgtgctgaccaaggggaagcgcgcgctgacgccgcccgtcagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtgtgcgaccaccggctcatgtccgccgcgatcaaggaccagaaggccgtccacgccgacatgggctactggatcgagagctccaagaaccagacctggcagatcgagaaggccagcctgatcgaggtgaagacgtgcctgtggcccaagacccacaccctctggtccaacggggtgctggagagccagatgctgatccccaagtcctacgcgggcccgttcagccagcacaactaccgccaggggtacgccacccagaccgtcggcccctggcacctcgggaagctggagatcgacttcggcgagtgccccggcacgaccgtgaccatccaggaggactgcgaccaccgggggcccagcctgcgcaccacgaccgcctccggcaagctcgtgacccagtggtgctgccgcagctgcaccatgccgcccctgcggttcctgggggaggacggctgctggtacgggatggagatccgccccctcaacgagaaggaggagaacatggtcaagtcccaggtgacggccggccagggcaccagcgagaccttctccatggggctgctgtgcctcaccctgttcgtcgaggagtgcctgcggcgccgggtgacgcgcaagcacatgatgctcgtggtcgtgatcaccctgtgcgccatcatcctgggcgggctcacctggatggacctgctgcgggcgctcatcatgctgggcgacaccatgagcggccgcatcgggggccagatccacctggccatcatggccgtgttcaagatgtcccccgggtacgtcctcggcgtgttcctgcggaagctgacgagccgcgagaccgccctcatggtgatcgggatggccatgaccaccgtcctgtccatcccgcacgacctgatggagctcatcgacggcatcagcctgggcctgatcctcctgaagacggtgacccagttcgacaacacccaggtggggaccctggcgctctccctgacgttcatccggagcaccatgcccctggtcatggcctggcgcaccatcatggccgtcctcttcgtggtcaccctgatccccctgtgccggacgtcctgcctccagaagcagagccactgggtggagatcaccgccctgatcctgggcgcccaggcgctccccgtgtacctgatgaccctgatgaagggggcctcccgccggagctggccgctcaacgagggcatcatggccgtcgggctggtgtccctgctcggcagcgccctgctgaagaacgacgtgcccctcgcgggccccatggtcgccgggggcctgctgctcgccgcctacgtgatgtccgggagcagcgccgacctgtccctggagaaggcggccaacgtgcagtgggacgagatggccgacatcaccggcagctcccccatcatcgaggtcaagcaggacgaggacgggagcttctccatccgcgacgtggaggagacgaacatgatcaccctcctggtgaagctggccctcatcaccgtcagcggcctgtacccgctggccatccccgtgaccatgacgctctggtacatgtggcaggtcaagacccagcggtccggcgcgctgtgggacgtccccagccccgccgccacccagaaggccgccctgtccgagggggtgtaccgcatcatgcagcggggcctcttcgggaagacccaggtgggcgtcgggatccacatggagggcgtgttccacaccatgtggcacgtgacgcgcggcagcgtcatctgccacgagaccgggcggctggagccgtcctgggcggacgtgcgcaacgacatgatcagctacggcgggggctggcgcctgggcgacaagtgggacaaggaggaggacgtgcaggtcctcgccatcgagcccgggaagaaccccaagcacgtgcagaccaagcccggcctgttcaagaccctgacgggggagatcggcgccgtgaccctcgacttcaagccggggacctccggcagccccatcatcaacaagaagggcaaggtcatcgggctgtacggcaacggggtggtgaccaagtccggcgactacgtcagcgccatcacgcaggccgagcggatcggggagcccgactacgaggtggacgaggacatcttccgcaagaagcggctgaccatcatggacctccacccgggcgcgggcaagaccaagcgcatcctgccctccatcgtgcgggaggccctgaagcgccggctgcgcaccctcatcctggcccccacgcgggtcgtggccgcggagatggaggaggccctgcgcgggctccccatccggtaccagaccccggccgtcaagagcgagcacaccggccgcgagatcgtcgacctgatgtgccacgccaccttcacgacccggctgctctccagcacccgcgtgcccaactacaacctgatcgtcatggacgaggcccacttcaccgaccccagctccgtggcggcccgggggtacatcagcacgcgcgtggagatgggcgaggccgccgccatcttcatgaccgcgacgcccccgggggccaccgaccccttcccccagtccaacagccccatcgaggacatcgagcgggagatcccggagcgctcctggaacacgggcttcgactggatcaccgactaccagggcaagaccgtctggttcgtgcccagcatcaaggccgggaacgacatcgccaactgcctgcggaagtccggcaagaaggtgatccagctcagccgcaagaccttcgacacggagtaccccaagaccaagctgaccgactgggacttcgtcgtgaccacggacatctccgagatgggggccaacttccgcgcgggccgggtgatcgacccccgccggtgcctgaagccggtcatcctcaccgacgggcccgagcgcgtgatcctggccggccccatccccgtgaccccggccagcgccgcgcagcggcgcggccggatcgggcgcaaccccgcccaggaggacgaccagtacgtcttctccggcgaccccctgaagaacgacgaggaccacgcccactggaccgaggccaagatgctcctggacaacatctacacgcccgaggggatcatcccgaccctgttcggccccgagcgggagaagacccaggccatcgacggcgagttccgcctccgcggggagcagcgcaagaccttcgtggagctgatgcggcgcggcgacctgcccgtgtggctcagctacaaggtcgcgtccgccgggatcagctacaaggaccgggagtggtgcttcacgggcgagcgcaacaaccagatcctggaggagaacatggaggtggagatctggacccgggagggggagaagaagaagctgcgcccccggtggctcgacgcccgcgtgtacgccgacccgatggccctgaaggacttcaaggagttcgcgtccggccgcaagagcatcaccctggacatcctcaccgagatcgcctccctgcccacctacctgagctcccgcgccaagctcgccctggacaacatcgtcatgctgcacacgaccgagcgcggcgggcgggcctaccagcacgcgctcaacgagctgcccgagagcctggagaccctcatgctggtggccctgctcggcgccatgaccgccgggatcttcctgttcttcatgcagggcaaggggatcggcaagctgagcatgggcctcatcgcgatcgccgtggcctccgggctgctgtgggtcgccgagatccagccgcagtggatcgccgcgagcatcatcctcgagttcttcctgatggtgctgctcatccccgagcccgagaagcagcgcacgccccaggacaaccagctgatctacgtgatcctgaccatcctcaccatcatcggcctgatcgccgccaacgagatggggctgatcgagaagaccaagacggacttcggcttctaccaggtcaagaccgagaccaccatcctcgacgtggacctgcggccggcctccgcctggacgctgtacgcggtggccaccaccatcctcacccccatgctgcgccacacgatcgagaacaccagcgccaacctgtccctcgccgccatcgcgaaccaggccgccgtcctgatggggctgggcaagggctggcccctccaccggatggacctgggggtgcccctgctcgccatgggctgctacagccaggtgaacccgaccaccctgacggcctccctggtcatgctcctggtgcactacgcgatcatcgggcccggcctgcaggccaaggccacccgcgaggcccagaagcggaccgcggccggcatcatgaagaaccccaccgtggacgggatcacggtcatcgacctcgagcccatcagctacgacccgaagttcgagaagcagctgggccaggtgatgctgctcgtgctgtgcgccgggcagctgctcctgatgcgcaccacctgggccttctgcgaggtcctgaccctcgccacgggccccatcctgaccctgtgggaggggaaccccggccggttctggaacaccaccatcgcggtgtccacggccaacatcttccgcggcagctacctcgccggggccggcctggccttctccctgatcaagaacgcgcagacgccccggcgcgggaccggcaccacgggggagaccctcggcgagaagtggaagcggcagctgaacagcctggaccgcaaggagttcgaggagtacaagcggtccggcatcctcgaggtggaccgcaccgaggccaagagcgccctgaaggacgggtccaagaccaagcacgccgtcagccggggctccagcaagatccgctggatcgtggagcgggggatggtgaagccgaagggcaaggtcgtggacctggggtgcggccgcggcgggtggtcctactacatggccaccctcaagaacgtgacggaggtcaagggctacaccaagggcggccccgggcacgaggagcccatccccatggcgacctacggctggaacctggtgaagctgcacagcggcgtggacgtcttctacaagccgaccgagcaggtcgacacgctcctgtgcgacatcggggagagctccagcaaccccaccatcgaggagggccgcaccctgcgggtgctcaagatggtcgagccctggctgtccagcaagcccgagttctgcatcaaggtgctgaacccgtacatgcccaccgtcatcgaggagctggagaagctccagcgcaagcacgggggcaacctggtgcggtgccccctgtcccgcaacagcacgcacgagatgtactgggtgtccggcgccagcgggaacatcgtctccagcgtgaacaccacctccaagatgctcctgaaccggttcaccacgcgccaccggaagcccacctacgagaaggacgtggacctgggcgccgggacccgcagcgtctccaccgagacggagaagccggacatgaccatcatcggccggcgcctccagcggctgcaggaggagcacaaggagacctggcactacgaccaggagaacccctaccgcacctgggcctaccacgggagctacgaggcgccctccacgggcagcgcctccagcatggtgaacggcgtggtcaagctgctcaccaagccgtgggacgtgatccccatggtgacccagctggccatgaccgacacgacccccttcgggcagcagcgggtcttcaaggagaaggtggacacccgcacgccccagccgaagcccggcacgcggatgatcatgaccaccaccgccaactggctgtgggccctcctggggaagaagaagaacccccgcctgtgcacgcgggaggagttcatctccaaggtgcgcagcaacgcggccatcggcgccgtcttccaggaggagcaggggtggaccagcgcctccgaggccgtgaacgacagccggttctgggagctcgtggacaaggagcgcgcgctgcaccaggagggcaagtgcgagtcctgcgtctacaacatgatgggcaagcgggagaagaagctgggggagttcggccgcgccaaggggagccgcgccatctggtacatgtggctcggcgcccggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgcggacgacaccgccggctgggacacccgcatcacggaggacgacctgcagaacgaggagctcatcaccgagcagatggcgccccaccacaagatcctggccaaggcgatcttcaagctgacctaccagaacaaggtggtcaaggtgctccggccgacgccccgcggggccgtgatggacatcatctcccggaaggaccagcggggcagcgggcaggtcggcacctacgggctgaacacgttcaccaacatggaggtgcagctgatccggcagatggaggccgagggcgtgatcacccaggacgacatgcagaaccccaagggcctcaaggagcgcgtcgagaagtggctgcgggagtgcggggtggaccgcctgaagcggatggccatctccggcgacgactgcgtggtcaagcccctcgacgagcgcttcgggaccagcctgctgttcctcaacgacatgggcaaggtgcggaaggacatcccgcagtgggagccctccaaggggtggaagaactggcaggaggtgcccttctgcagccaccacttccacaagatcttcatgaaggacggccgctccctggtcgtgccctgccggaaccaggacgagctgatcggccgcgcccggatcagccagggggcgggctggtccctccgcgagacggcctgcctggggaaggcctacgcccagatgtggagcctgatgtacttccaccgccgggacctccgcctggcctccatggcgatctgcagcgccgtgccgaccgagtggttccccaccagccggaccacgtggtccatccacgcccaccaccagtggatgaccaccgaggacatgctgaaggtctggaaccgcgtgtggatcgaggacaaccccaacatgaccgacaagacgcccatccacagctgggaggacatcccgtacctcggcaagcgggaggacctgtggtgcgggtccctgatcggcctcagctcccgcgccacctgggccaagaacatccacaccgcgatcacccaggtgcggaacctgatcggcaaggaggagtacgtcgactacatgcccgtgatgaagcgctacagcgccccctccgagagcgagggggtgctgtga

SEQ ID NO: 10442 - RNA, 9867 nt, synthetic construct
  misc_feature 1..9867: note = derived and/or modified CDS sequence (opt1) from DENV-4__FJ810417__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcatccccctggcggagaacaccaactccgtgacgaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagaccgcgtgggacttcgggtccgtgggcggcctcttcacgagcctggggaaggccgtccaccaggtgttcggctccgtgtacaccaccatgttcgggggcgtcagctggatgatccgcatcctgatcgggttcctcgtgctgtggatcggcaccaactcccggaacacgagcatggccatgacctgcatcgccgtgggcgggatcaccctgttcctgggcttcaccgtccaggccgacatggggtgcgtggtgtcctggagcggccgcgagctcaagtgcgggagcggcatcttcgtcgtggacaacgtgcacacgtggaccgagcagtacaagttccagcccgagtcccccgcgcggctggccagcgccatcctgaacgcccacaaggacggcgtctgcgggatccgctccaccacccggctcgagaacgtgatgtggaagcagatcacgaacgagctgaactacgtgctgtgggagggcgggcacgacctcaccgtcgtggccggcgacgtgaagggcgtcctgaccaaggggaagcgcgcgctgaccccgcccgtgagcgacctcaagtactcctggaagacgtggggcaaggccaagatcttcacccccgaggcccggaacagcaccttcctgatcgacgggcccgacacctccgagtgcccgaacgagcgccgggcctggaacagcctggaggtggaggactacggcttcgggatgttcacgaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacctgcctgtggcccaagacgcacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcaccacggtgaccatccaggaggactgcgaccaccgggggcccagcctgcgcaccaccacggcctccggcaagctcgtcacccagtggtgctgccgcagctgcaccatgccgcccctgcggttcctgggggaggacggctgctggtacgggatggagatccgccccctcaacgagaaggaggagaacatggtgaagtcccaggtcaccgccggccagggcacgagcgagaccttctccatggggctgctgtgcctcaccctgttcgtggaggagtgcctgcggcgccgggtgacccgcaagcacatgatcctcgtcgtggtgatcacgctgtgcgccatcatcctgggcgggctcacctggatggacctgctgcgggcgctcatcatgctgggcgacaccatgagcggccgcatcgggggccagatccacctggccatcatggccgtcttcaagatgtcccccgggtacgtgctcggcgtgttcctgcggaagctgaccagccgcgagacggccctcatggtcatcgggatggccatgaccaccgtgctgtccatcccgcacgacctgatggagctcatcgacggcatcagcctgggcctgatcctcctgaagatcgtgacccagttcgacaacacgcaggtcgggaccctggcgctctccctgaccttcatccggagcaccatgcccctggtgatggcctggcgcacgatcatggccgtgctcttcgtcgtgaccctgatccccctgtgccggacctcctgcctccagaagcagagccactgggtggagatcaccgccctgatcctgggcgcccaggcgctccccgtctacctgatgacgctgatgaagggggcctcccgccggagctggccgctcaacgagggcatcatggccgtggggctggtgtccctgctcggcagcgccctgctgaagaacgacgtccccctcgcgggccccatggtggccgggggcctgctgctcgccgcctacgtgatgtccgggagcagcgccgacctgtccctggagaaggcggccaacgtccagtgggacgagatggccgacatcaccggcagctcccccatcatcgaggtgaagcaggacgaggacgggagcttctccatccgcgacgtggaggagaccaacatgatcaccctcctggtcaagctggccctcatcacggtgagcggcctgtacccgctggccatccccgtgaccatgaccctctggtacatgtggcaggtcaagacccagcggtccggcgcgctgtgggacgtgcccagccccgccgccacgcagaaggccgccctgtccgagggggtgtaccgcatcatgcagcggggcctcttcgggaagacccaggtcggcgtggggatccacatggagggcgtgttccacaccatgtggcacgtcacccgcggcagcgtgatctgccacgagaccgggcggctggagccgtcctgggcggacgtgcgcaacgacatgatcagctacggcgggggctggcgcctgggcgacaagtgggacaaggaggaggacgtccaggtgctcgccatcgagcccgggaagaaccccaagcacgtgcagacgaagcccggcctgttcaagaccctgaccggggagatcggcgccgtcaccctcgacttcaagccggggacgtccggcagccccatcatcaaccggaagggcaaggtgatcgggctgtacggcaacggggtggtcaccaagtccggcgactacgtgagcgccatcacccaggccgagcgcatcggggagcccgactacgaggtggacgaggacatcttccggaagaagcgcctgaccatcatggacctccacccgggcgcgggcaagacgaagcggatcctgccctccatcgtccgcgaggccctgaagcggcgcctgcggaccctcatcctggcccccacccgcgtggtggccgcggagatggaggaggccctgcgggggctccccatccgctaccagaccccggccgtcaagagcgagcacacgggccgggagatcgtggacctgatgtgccacgccaccttcaccacccgcctgctctccagcacgcgggtccccaactacaacctgatcgtgatggacgaggcccacttcaccgaccccagctccgtggcggcccgcgggtacatcagcacccgggtcgagatgggcgaggccgccgccatcttcatgaccgcgacgcccccgggggccaccgaccccttcccccagtccaacagccccatcgaggacatcgagcgcgagatcccggagcggtcctggaacaccggcttcgactggatcaccgactaccagggcaagacggtgtggttcgtgcccagcatcaaggccgggaacgacatcgccaactgcctgcgcaagtccggcaagaaggtcatccagctcagccgcaagaccttcgacaccgagtaccccaagaccaagctgacggactgggacttcgtggtgaccaccgacatctccgagatgggggccaacttccgggcgggccgcgtcatcgacccccggcgctgcctgaagccggtgatcctcaccgacgggcccgagcgggtgatcctggccggccccatccccgtcacgccggccagcgccgcgcagcgccggggccgcatcgggcggaaccccgcccaggaggacgaccagtacgtgttctccggcgaccccctgaagaacgacgaggaccacgcccactggaccgaggccaagatgctcctggacaacatctacacccccgaggggatcatcccgaccctgttcggccccgagcgcgagaagacgcaggccatcgacggcgagttccggctccgcggggagcagcggaagaccttcgtggagctgatgcgccggggcgacctgcccgtctggctcagctacaaggtggcgtccgccgggatcagctacaaggaccgcgagtggtgcttcaccggcgagcggaacaaccagatcctggaggagaacatggaggtggagatctggacccgcgagggggagaagaagaagctgcggccccgctggctcgacgcccgggtctacgccgacccgatggccctgaaggacttcaaggagttcgcgtccggccgcaagagcatcacgctggacatcctcaccgagatcgcctccctgcccacctacctgagctcccgcgccaagctcgccctggacaacatcgtgatgctgcacaccaccgagcggggcgggcgcgcctaccagcacgcgctcaacgagctgcccgagagcctggagacgctcatgctggtggccctgctcggcgccatgaccgccgggatcttcctgttcttcatgcagggcaaggggatcggcaagctgagcatgggcctcatcgcgatcgccgtcgcctccgggctgctgtgggtggccgagatccagccgcagtggatcgccgcgagcatcatcctcgagttcttcctgatggtgctgctcatccccgagcccgagaagcagcggaccccccaggacaaccagctgatctacgtcatcctgaccatcctcacgatcatcggcctgatcgccgccaacgagatggggctgatcgagaagaccaagaccgacttcggcttctaccaggtgaagaccgagacgaccatcctcgacgtggacctgcgcccggcctccgcctggaccctgtacgcggtcgccaccacgatcctcacccccatgctgcggcacaccatcgagaacaccagcgccaacctgtccctcgccgccatcgcgaaccaggccgccgtgctgatggggctgggcaagggctggcccctccaccgcatggacctgggggtgcccctgctcgccatgggctgctacagccaggtcaacccgacgaccctgaccgcctccctggtgatgctcctggtgcactacgcgatcatcgggcccggcctgcaggccaaggccacccgggaggcccagaagcgcacggcggccggcatcatgaagaaccccaccgtcgacgggatcaccgtgatcgacctcgagcccatcagctacgacccgaagttcgagaagcagctgggccaggtgatgctgctcgtcctgtgcgccgggcagctgctcctgatgcggaccacgtgggccttctgcgaggtgctgaccctcgccaccggccccatcctgaccctgtgggaggggaaccccggccgcttctggaacacgaccatcgcggtgtccaccgccaacatcttccggggcagctacctcgccggggccggcctggccttctccctgatcaagaacgcgcagaccccccgccgggggacgggcaccaccggggagaccctcggcgagaagtggaagcgccagctgaacagcctggaccggaaggagttcgaggagtacaagcgctccggcatcctcgaggtcgaccggacggaggccaagagcgccctgaaggacgggtccaagaccaagcacgccgtgagccgcggctccagcaagatccggtggatcgtggagcgcgggatggtcaagccgaagggcaaggtggtggacctggggtgcggccgcggcgggtggtcctactacatggccaccctcaagaacgtcaccgaggtgaagggctacaccaaggggggccccgggcacgaggagcccatccccatggcgacgtacggctggaacctggtgaagctgcacagcggcgtcgacgtgttctacaagccgaccgagcaggtggacaccctcctgtgcgacatcggggagagctccagcaaccccaccatcgaggagggccggacgctgcgcgtcctcaagatggtggagccctggctgtccagcaagcccgagttctgcatcaaggtcctgaacccgtacatgcccaccgtgatcgaggagctggagaagctccagcggaagcacgggggcaacctggtgcgctgccccctgtcccggaacagcacccacgagatgtactgggtctccggcgccagcgggaacatcgtgtccagcgtgaacaccacgtccaagatgctcctgaaccgcttcaccacccggcaccgcaagcccacctacgagaaggacgtcgacctgggcgccgggacgcggagcgtgtccaccgagaccgagaagccggacatgaccatcatcggccgccggctccagcgcctgcaggaggagcacaaggagacgtggcactacgaccaggagaacccctaccggacctgggcctaccacgggagctacgaggcgccctccaccggcagcgcctccagcatggtgaacggcgtcgtgaagctgctcaccaagccgtgggacgtgatccccatggtcacgcagctggccatgaccgacaccacccccttcgggcagcagcgcgtgttcaaggagaaggtggacacgcggaccccccagccgaagcccggcacccgcatgatcatgaccacgaccgccaactggctgtgggccctcctggggaagaagaagaacccccggctgtgcacccgcgaggagttcatctccaaggtccggagcaacgcggccatcggcgccgtgttccaggaggagcaggggtggaccagcgcctccgaggccgtgaacgacagccgcttctgggagctcgtcgacaaggagcgggcgctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgcggacgacacggccggctgggacacccggatcaccgaggacgacctgcagaacgaggagctcatcaccgagcagatggccccccaccacaagatcctggccaaggcgatcttcaagctgacgtaccagaacaaggtcgtgaaggtgctccgcccgaccccccggggggccgtcatggacatcatctcccgcaaggaccagcggggcagcgggcaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggccatctccggcgacgactgcgtcgtgaagcccctcgacgagcggttcgggaccagcctgctgttcctcaacgacatgggcaaggtgcgcaaggacatcccgcagtgggagccctccaaggggtggaagaactggcaggaggtccccttctgcagccaccacttccacaagatcttcatgaaggacggccggtccctggtggtgccctgccgcaaccaggacgagctgatcggccgggcccgcatcagccagggggcgggctggtccctccgcgagaccgcctgcctggggaaggcctacgcccagatgtggagcctgatgtacttccaccggcgcgacctccggctggcctccatggcgatctgcagcgccgtcccgaccgagtggttccccacgagccgcaccacctggtccatccacgcccaccaccagtggatgaccacggaggacatgctgaaggtgtggaaccgggtgtggatcgaggacaaccccaacatgaccgacaagacccccatccacagctgggaggacatcccgtacctcggcaagcgcgaggacctgtggtgcgggtccctgatcggcctcagctcccgggccacctgggccaagaacatccacacggcgatcacccaggtccgcaacctgatcggcaaggaggagtacgtggactacatgcccgtgatgaagcggtacagcgccccctccgagagcgagggggtcctgtga

SEQ ID NO: 10443 - RNA, 9867 nt, synthetic construct
  misc_feature 1..9867: note = derived and/or modified CDS sequence (opt1) from DENV-4__FJ850057__SS-prME
  source 1..9867: mol_type = other RNA
agcaccatcaccctgctctgcctgatccccacggccatggccttccacctgtccacccgcgacggcgagccgctcatgatcgtggcgaagcacgagcgggggcgccccctgctgttcaagaccaccgagggcatcaacaagtgcacgctcatcgccatggacctgggggagatgtgcgaggacaccgtcacctacaagtgccccctgctcgtgaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgtccatcagcaacatcacgaccgccacccgctgcccgacccagggggagccctacctcaaggaggagcaggaccagcagtacatctgccggcgcgacgtggtggaccggggctgggggaacggctgcggcctgttcgggaagggcggggtcgtgacgtgcgccaagttctcctgcagcggcaagatcaccgggaacctggtgcagatcgagaacctcgagtacaccgtcgtggtgaccgtccacaacggcgacacgcacgccgtgggcaacgacacctccaaccacggggtcaccgccaccatcacgccccgcagcccctccgtggaggtgaagctgccggactacggcgagctgaccctcgactgcgagccccggagcgggatcgacttcaacgagatgatcctgatgaagatgaagaagaagacctggctggtccacaagcagtggttcctcgacctgcccctgccctggaccgcgggcgccgacacctccgaggtgcactggaactacaaggagcgcatggtgacgttcaaggtcccgcacgccaagcggcaggacgtgaccgtgctcgggagccaggagggcgccatgcacagcgccctggcgggcgccaccgaggtcgactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatctccagcacccccctggccgagaacacgaactccgtgaccaacatcgagctggagccgcccttcggggacagctacatcgtgatcggcgtcggcaactccgccctcaccctgcactggttccggaaggggagctccatcggcaagatgttcgagagcacctaccgcggggccaagcggatggcgatcctgggcgagacggcctgggacttcgggtccgtgggcggcctcttcaccagcctggggaaggccgtgcaccaggtcttcggctccgtgtacaccaccatgttcgggggcgtgagctggatgatccgcatcctgatcgggttcctcgtcctgtggatcggcacgaactcccggaacaccagcatggccatgacctgcatcgccgtgggcgggatcaccctgttcctgggcttcacggtgcaggcggacatggggtgcgtcgtgtcctggagcggccgcgagctcaagtgcgggagcggcatcttcgtggtcgacaacgtgcacacctggaccgagcagtacaagttccagcccgagtcccccgcccggctggccagcgccatcctgaacgcccacaaggacggcgtgtgcgggatccgctccaccacgcggctcgagaacgtcatgtggaagcagatcaccaacgagctgaactacgtgctgtgggagggcgggcacgacctcaccgtggtcgcgggcgacgtgaagggcgtgctgaccaaggggaagcgcgccctgacgccgcccgtcagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacctggcagatcgagaaggcgagcctgatcgaggtgaagacgtgcctgtggcccaagacccacaccctctggtccaacggggtgctggagagccagatgctgatccccaagtcctacgccggcccgttcagccagcacaactaccgccaggggtacgccacccagaccgtcggcccctggcacctcgggaagctggagatcgacttcggcgagtgccccggcacgaccgtgaccatccaggaggactgcgaccaccgggggcccagcctgcgcaccacgaccgcctccggcaagctcgtgacccagtggtgctgccgcagctgcaccatgccgcccctgcggttcctgggggaggacggctgctggtacgggatggagatccgccccctcaacgagaaggaggagaacatggtcaagtcccaggtgacggccggccagggcaccagcgagaccttctccatggggctgctgtgcctcaccctgttcgtcgaggagtgcctgcggcgccgggtgacgcgcaagcacatgatcctcgtggtcgtgatcaccctgtgcgcgatcatcctgggcgggctcacctggatggacctgctgcgggccctcatcatgctgggcgacaccatgagcggccgcatcgggggccagatccacctggccatcatggccgtgttcaagatgtcccccgggtacgtcctcggcgtgttcctgcggaagctgacgagccgcgagaccgccctcatggtgatcgggatggcgatgaccaccgtcctgtccatcccgcacgacctgatggagctcatcgacggcatcagcctgggcctgatcctcctgaagatcgtgacgcagttcgacaacacccaggtggggaccctggccctctccctgaccttcatccggagcacgatgcccctggtcatggcctggcgcaccatcatggccgtgctcttcgtggtcaccctgatccccctgtgccggacctcctgcctccagaagcagagccactgggtggagatcacggccctgatcctgggcgcgcaggccctccccgtgtacctgatgaccctgatgaagggggcctcccgccggagctggccgctcaacgagggcatcatggccgtcgggctggtgtccctgctcggcagcgcgctgctgaagaacgacgtgcccctcgccggccccatggtcgccgggggcctgctgctcgccgcctacgtgatgtccgggagcagcgcggacctgtccctggagaaggccgccaacgtgcagtgggacgagatggccgacatcaccggcagctcccccatcatcgaggtcaagcaggacgaggacgggagcttctccatccgcgacgtggaggagaccaacatgatcacgctcctggtgaagctggccctcatcaccgtcagcggcctgtacccgctggcgatccccgtgaccatgaccctctggtacatgtggcaggtgaagacgcagcggtccggcgccctgtgggacgtccccagccccgccgccacccagaaggccgcgctgtccgagggggtgtaccgcatcatgcagcggggcctcttcgggaagacccaggtgggcgtcgggatccacatggagggcgtgttccacaccatgtggcacgtgacccgcggcagcgtcatctgccacgagacggggcggctggagccgtcctgggccgacgtgcgcaacgacatgatcagctacggcgggggctggcgcctgggcgacaagtgggacaaggaggaggacgtgcaggtcctcgccatcgagcccgggaagaaccccaagcacgtgcagaccaagcccggcctgttcaagaccctgaccggggagatcggcgccgtgacgctcgacttcaagccggggacctccggcagccccatcatcaaccggaagggcaaggtcatcgggctgtacggcaacggggtggtgaccaagtccggcgactacgtcagcgccatcacccaggcggagcgcatcggggagcccgactacgaggtggacgaggacatcttccggaagaagcgcctgacgatcatggacctccacccgggcgccggcaagaccaagcggatcctgccctccatcgtgcgcgaggccctgaagcggcgcctgcggaccctcatcctggcccccacccgcgtcgtggcggccgagatggaggaggccctgcgggggctccccatccgctaccagacgccggccgtgaagagcgagcacaccggccgggagatcgtcgacctgatgtgccacgccaccttcaccacgcgcctgctctccagcacccgggtgcccaactacaacctgatcgtcatggacgaggcgcacttcaccgaccccagctccgtggccgcccgcgggtacatcagcacccgggtggagatgggcgaggccgccgcgatcttcatgacggccacccccccgggggccaccgaccccttcccccagtccaacagccccatcgaggacatcgagcgcgagatcccggagcggtcctggaacaccggcttcgactggatcacggactaccagggcaagaccgtctggttcgtgcccagcatcaaggccgggaacgacatcgccaactgcctgcgcaagtccggcaagaaggtgatccagctcagccgcaagaccttcgacaccgagtaccccaagacgaagctgaccgactgggacttcgtcgtgaccaccgacatctccgagatgggggcgaacttccgggccggccgcgtgatcgacccccggcgctgcctgaagccggtcatcctcacggacgggcccgagcgggtgatcctggccggccccatccccgtgaccccggccagcgcggcccagcgccggggccgcatcgggcggaaccccgcccaggaggacgaccagtacgtcttctccggcgaccccctgaagaacgacgaggaccacgcccactggaccgaggccaagatgctcctggacaacatctacacccccgaggggatcatcccgacgctgttcggccccgagcgcgagaagacccaggcgatcgacggcgagttccggctccgcggggagcagcggaagaccttcgtggagctgatgcgccggggcgacctgcccgtgtggctcagctacaaggtcgcctccgccgggatcagctacaaggaccgcgagtggtgcttcaccggcgagcggaacaaccagatcctggaggagaacatggaggtggagatctggacgcgcgagggggagaagaagaagctgcggccccgctggctcgacgcccgggtgtacgccgacccgatggcgctgaaggacttcaaggagttcgcctccggccgcaagagcatcaccctggacatcctcaccgagatcgcctccctgcccacctacctgagctcccgcgccaagctcgccctggacaacatcgtcatgctgcacaccacggagcggggcgggcgcgcgtaccagcacgccctcaacgagctgcccgagagcctggagaccctcatgctggtggccctgctcggcgccatgaccgcggggatcttcctgttcttcatgcagggcaaggggatcggcaagctgagcatgggcctcatcgccatcgccgtggcctccgggctgctgtgggtcgccgagatccagccgcagtggatcgcggccagcatcatcctcgagttcttcctgatggtgctgctcatccccgagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgcccggcctccgcgtggaccctgtacgccgtggccacgaccatcctcacccccatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaacccgaccaccctgaccgcgtccctggtcatgctcctggtgcactacgccatcatcgggcccggcctgcaggccaaggccacgcgggaggcgcagaagcgcaccgccgccggcatcatgaagaaccccaccgtggacgggatcaccgtcatcgacctcgagcccatcagctacgacccgaagttcgagaagcagctgggccaggtgatgctgctcgtgctgtgcgccgggcagctgctcctgatgcggacgacctgggccttctgcgaggtcctgaccctcgcgaccggccccacgctgaccctgtgggaggggaaccccggccgcttctggaacaccaccatcgccgtgtccacggccaacatcttccggggcagctacctcgccggggccggcctggcgttctccctgatcaagaacgcccagaccccccgccgggggaccggcaccacgggggagaccctcggcgagaagtggaagcgccagctgaacagcctggaccggaaggagttcgaggagtacaagcgctccggcatcctcgaggtggaccggaccgaggccaagagcgccctgaaggacgggtccaagaccaagcacgccgtcagccgcggctccagcaagatccggtggatcgtggagcgcgggatggtgaagccgaagggcaaggtcgtggacctggggtgcggccgcggcgggtggtcctactacatggcgaccctcaagaacgtgacggaggtcaagggctacaccaaggggggccccgggcacgaggagcccatccccatggccacctacggctggaacctggtgaagctgcacagcggcgtggacgtcttctacaagccgaccgagcaggtggacacgctcctgtgcgacatcggggagagctccagcaaccccaccatcgaggagggccggaccctgcgcgtgctcaagatggtcgagccctggctgtccagcaagcccgagttctgcatcaaggtgctgaacccgtacatgcccaccgtcatcgaggagctggagaagctccagcggaagcacgggggcaacctggtgcgctgccccctgtcccggaacagcacgcacgagatgtactgggtgtccggcgccagcgggaacatcgtctccagcgtgaacaccacctccaagatgctcctgaaccgcttcaccacgcggcaccgcaagcccacctacgagaaggacgtggacctgggcgccgggacccggagcgtctccaccgagacggagaagccggacatgaccatcatcggccgccggctccagcgcctgcaggaggagcacaaggagacctggcactacgaccaggagaacccctaccggacctgggcgtaccacgggagctacgaggccccctccacgggcagcgcctccagcatggtgaacggcgtggtcaagctgctcaccaagccgtgggacgtgatccccatggtgacccagctggccatgaccgacacgacccccttcgggcagcagcgcgtcttcaaggagaaggtggacacccggaccccccagccgaagcccggcacgcgcatgatcatgaccaccaccgccaactggctgtgggcgctcctggggaagaagaagaacccccggctgtgcacgcgcgaggagttcatctccaaggtgcggagcaacgccgccatcggcgccgtcttccaggaggagcaggggtggaccagcgcctccgaggcggtgaacgacagccgcttctgggagctcgtggacaaggagcgggccctgcaccaggagggcaagtgcgagtcctgcgtctacaacatgatgggcaagcgcgagaagaagctgggggagttcggccgcgccaaggggagccgggccatctggtacatgtggctcggcgcccgcttcctggagttcgaggcgctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggccccccaccacaagatcctggcgaaggccatcttcaagctgacctaccagaacaaggtggtcaaggtgctccgcccgaccccccggggggccgtgatggacatcatctcccgcaaggaccagcggggcagcgggcaggtcggcacctacgggctgaacacgttcaccaacatggaggtgcagctgatccgccagatggaggccgagggcgtgatcacccaggacgacatgcagaaccccaagggcctcaaggagcgggtcgagaagtggctgcgcgagtgcggggtggaccggctgaagcgcatggccatctccggcgacgactgcgtggtcaagcccctcgacgagcggttcgggaccagcctgctgttcctcaacgacatgggcaaggtgcgcaaggacatcccgcagtgggagccctccaaggggtggaagaactggcaggaggtgcccttctgcagccaccacttccacaagatcttcatgaaggacggccggtccctggtcgtgccctgccgcaaccaggacgagctgatcggccgggcgcgcatcagccagggggccggctggtccctccgcgagacggcctgcctggggaaggcctacgcccagatgtggagcctgatgtacttccaccggcgcgacctccggctggcgtccatggccatctgcagcgccgtgccgaccgagtggttccccaccagccgcaccacgtggtccatccacgcccaccaccagtggatgaccaccgaggacatgctgaaggtctggaaccgggtgtggatcgaggacaaccccaacatgaccgacaagacgcccatccacagctgggaggacatcccgtacctcggcaagcgcgaggacctgtggtgcgggtccctgatcggcctcagctcccgggccacctgggcgaagaacatccacaccgccatcacccaggtgcgcaacctgatcggcaaggaggagtacgtcgactacatgcccgtgatgaagcggtacagcgccccctccgagagcgagggggtgctgtga

SEQ ID NO: 10444 - RNA, 9867 nt, synthetic construct
  misc_feature 1..9867: note = derived and/or modified CDS sequence (opt1) from DENV-4__GQ199881__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagacccgcatccagcggacggtcttcttcgtgctgatgatgctggtggccccctcctacgggatgcgctgcgtcggcgtgggcaaccgggacttcgtggagggggtcagcggcggggcgtgggtggacctcgtgctggagcacggcggctgcgtcaccaccatggcccaggggaagcccaccctggacttcgagctcacgaagaccaccgccaaggaggtggccctgctgcgcacctactgcatcgaggcctccatcagcaacatcacgaccgcgacccggtgcccgacccagggcgagccctacctcaaggaggagcaggaccagcagtacatctgccgccgggacgtggtcgaccgcgggtggggcaacgggtgcggcctgttcggcaaggggggcgtggtgacgtgcgccaagttctcctgcagcgggaagatcaccggcaacctggtccagatcgagaacctcgagtacaccgtggtggtcaccgtgcacaacggggacacgcacgccgtcggcaacgacacctccaaccacggcgtgaccgccaccatcacgccccggagcccctccgtggaggtcaagctgccggactacggggagctgaccctcgactgcgagccccgcagcggcatcgacttcaacgagatgatcctgatgaagatgaagaagaagacctggctggtgcacaagcagtggttcctcgacctgcccctgccctggaccgccggggcggacacctccgaggtgcactggaactacaaggagcggatggtcacgttcaaggtgccgcacgccaagcgccaggacgtgaccgtcctcggcagccaggagggggccatgcacagcgccctggccggcgcgaccgaggtggactccggcgacgggaaccacatgttcgccggccacctgaagtgcaaggtgcgcatggagaagctccggatcaaggggatgagctacaccatgtgctccggcaagttcagcatcgacaaggagatggccgagacgcagcacggcaccaccgtcgtgaaggtgaagtacgagggggccggcgccccctgcaaggtccccatcgagatccgcgacgtgaacaaggagaaggtggtcgggcgggtgatctccagcacccccctggcggagaacacgaactccgtgaccaacatcgagctggagccgcccttcggcgacagctacatcgtcatcggggtgggcaactccgccctcaccctgcactggttccgcaagggcagctccatcgggaagatgttcgagagcacctaccggggcgccaagcgcatggccatcctgggggagacggcgtgggacttcggctccgtggggggcctcttcaccagcctgggcaaggccgtccaccaggtgttcgggtccgtgtacaccaccatgttcggcggggtcagctggatgatccggatcctgatcggcttcctcgtgctgtggatcgggacgaactcccgcaacaccagcatggccatgacctgcatcgccgtgggcggcatcaccctgttcctggggttcacggtccaggccgacatgggctgcgtggtgtcctggagcgggcgggagctcaagtgcggcagcgggatcttcgtcgtggacaacgtgcacacctggaccgagcagtacaagttccagcccgagtcccccgcgcgcctggccagcgccatcctgaacgcccacaaggacggcgtctgcggcatccggtccaccacgcgcctcgagaacgtgatgtggaagcagatcaccaacgagctgaactacgtgctgtgggaggggggccacgacctcaccgtcgtggccggggacgtgaagggcgtcctgaccaagggcaagcgggcgctgacgccgcccgtgagcgacctcaagtactcctggaagacctgggggaaggccaagatcttcacccccgaggcccgcaacagcaccttcctgatcgacggccccgacacgtccgagtgcccgaacgagcggcgcgcctggaacagcctggaggtggaggactacgggttcggcatgttcaccaccaacatctggatgaagttccgggaggggtccagcgaggtctgcgaccaccgcctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggcgtcctggagagccagatgctgatccccaagtcctacgcggggccgttcagccagcacaactaccggcagggctacgccacccagaccgtggggccctggcacctcggcaagctggagatcgacttcggggagtgccccggcacgaccgtgaccatccaggaggactgcgaccaccgcggccccagcctgcgcaccacgaccgcctccgggaagctcgtcacccagtggtgctgccggagctgcaccatgccgcccctgcgcttcctgggcgaggacgggtgctggtacggcatggagatccggcccctctccgagaaggaggagaacatggtgaagagccaggtcgccgccgggcagggcacgtccgagaccttcttcatgggcctgctgtgcctcaccctgttcgtggaggagtgcctgcgccggcgcgtgacccggaagcacatgatcctcgcggtcgtgatcacgctgtgcgccatcatcctggggggcctcacctggatggacctgctgcgcgccctcatcatgctgggggacaccatgagcggccggatcggcgggcagacccacctggccatcatggccgtgttcaagatgtcccccggctacgtcctcggggtgttcctgcgcaagctgacgagccgggagaccgcgctcatggtgatcggcatggccatgaccaccacgctgtccatcccgcacgacctgatggagctcatcgacgggatcagcctgggcctgatcctcctgaagatcgtcacccagttcgacaacacccaggtgggcaccctggccctctccctgacgttcatccgcagcaccatgtccctggtgatggcctggcggaccatcatggccgtcctcttcgtggtgaccctgatccccctgtgccgcacgagctgcctccagaagcagtcccactgggtcgagatcaccgcgctgatcctgggggcccaggccctccccgtgtacctgatgaccctgatgaagggcgccagccggcgctcctggcccctcaacgaggggatgatggcggtgggcctggtcagcctgctcgggtccgccctgctgaagaacgacgtgccgctcgccggccccatggtggccggcgggctgctgctcgccgcgtacgtcatgagcggcagctccgccgacctgagcctggagaaggccgccaacgtgcagtgggacgagatggccgacatcaccgggtccagccccatcatcgaggtgaagcaggacgaggacggctccttcagcatccgggacgtcgaggagacgaacatgatcaccctcctggtgaagctggcgctcatcaccgtgtccgggctgtaccccctggccatcccggtcaccatgacgctctggtacatgtggcaggtgaagacccagcgcagcggcgccctgtgggacgtgccctcccccgccgccacccagaaggcggccctgagcgagggcgtctaccggatcatgcagcgcgggctcttcggcaagacccaggtgggggtgggcatccacatggagggggtcttccacaccatgtggcacgtgacgcggggctccgtgatctgccacgagaccggccgcctggagcccagctgggccgacgtccgcaacgacatgatctcctacgggggcgggtggcggctgggcgacaagtgggacaaggaggaggacgtgcaggtgctcgccatcgagccgggcaagaaccccaagcacgtccagaccaagcccgggctgttcaagaccctgacgggcgagatcggggccgtgaccctcgacttcaagcccggcagctccgggagcccgatcatcaaccgcaagggcaaggtgatcggcctgtacgggaacggcgtcgtgaccaagtccggggactacgtgagcgcgatcacccaggccgagcggatcggcgagcccgactacgaggtcgacgaggacatcttccgcaagaagcggctgacgatcatggacctccaccccggggccggcaagaccaagcgcatcctgccgtccatcgtgcgggaggccctgaagcgccggctgcgcaccctcatcctggcgcccacccgggtggtcgccgccgagatggaggaggccctgcgcggcctccccatccggtaccagacgcccgccgtgaagagcgagcacaccgggcgcgagatcgtggacctgatgtgccacgcgaccttcaccacgcggctgctcagctccacccgcgtcccgaactacaacctgatcgtgatggacgaggcccacttcaccgaccccagctccgtcgccgcccggggctacatcagcacccgcgtggagatgggggaggccgcggccatcttcatgacggccaccccccccggcgccaccgacccgttcccccagtccaacagccccatcgaggacatcgagcgggagatccccgagcgctcctggaacaccgggttcgactggatcacggactaccagggcaagaccgtgtggttcgtcccgagcatcaaggccggcaacgacatcgcgaactgcctgcgcaagtccgggaagaaggtgatccagctcagccggaagaccttcgacaccgagtaccccaagacgaagctgaccgactgggacttcgtggtcaccaccgacatctccgagatgggcgccaacttccgcgccgggcgggtgatcgacccccgccggtgcctgaagcccgtgatcctcacggacggcccggagcgcgtcatcctggccgggcccatccccgtgacccccgcgagcgccgcccagcggcgcggccggatcggccgcaacccggcccaggaggacgaccagtacgtgttctccggggaccccctgaagaacgacgaggaccacgcccactggaccgaggcgaagatgctcctggacaacatctacacccccgagggcatcatccccacgctgttcgggccggagcgggagaagacccaggccatcgacggcgagttccgcctccggggcgagcagcgcaagaccttcgtcgagctgatgcggcgcggggacctgcccgtgtggctcagctacaaggtggcctccgccggcatcagctacaaggaccgggagtggtgcttcaccggggagcgcaacaaccagatcctggaggagaacatggaggtcgagatctggacgcgggagggcgagaagaagaagctgcgcccccggtggctcgacgcccgcgtgtacgcggaccccatggccctgaaggacttcaaggagttcgcctccgggcgcaagagcatcaccctggacatcctcaccgagatcgcctccctgccgacctacctgagcagccgggccaagctcgcgctggacaacatcgtgatgctgcacaccacggagcgcggcggccgggcctaccagcacgccctcaacgagctgcccgagtccctggagaccctcatgctggtcgccctgctcggggcgatgaccgccggcatcttcctgttcttcatgcaggggaagggcatcgggaagctgagcatgggcctcatcaccatcgccgtggcctccggcctgctgtgggtggccgagatccagccccagtggatcgcggccagcatcatcctcgagttcttcctgatggtcctgctcatcccggagcccgagaagcagcgcacgccccaggacaaccagctgatctacgtgatcctggccatcctcaccatcatcgggctgatcgccgccaacgagatgggcctgatcgagaagaccaagaccgacttcgggttctaccaggtgaagacggagaccaccatcctcgacgtcgacctgcggcccgcgtccgcctggaccctgtacgccgtggccacgaccatcctcaccccgatgctgcgccacaccatcgagaacacgagcgccaacctgtccctcgcggccatcgccaaccaggccgccgtgctgatgggcctggggaagggctggcccctccaccggatggacctgggcgtccccctgctcgcgatggggtgctacagccaggtgaaccccaccaccctgaccgcctccctggtgatgctcctggtccactacgccatcatcggcccggggctgcaggccaaggcgacgcgcgaggcccagaagcggaccgccgccggcatcatgaagaaccccaccgtggacggcatcaccgtgatcgacctcgagcccatcagctacgaccccaagttcgagaagcagctggggcaggtcatgctgctcgtgctgtgcgccggccagctgctcctgatgcgcacgacctgggcgttctgcgaggtgctgaccctcgccaccgggccgatcctgacgctgtgggagggcaaccccgggcggttctggaacaccaccatcgccgtctccaccgccaacatcttccgcggcagctacctcgccggcgcggggctggccttctccctgatcaagaacgcccagacgccccggcgcggcaccgggaccaccggcgagacgctcggggagaagtggaagcggcagctgaacagcctggaccgcaaggagttcgaggagtacaagcggtccggcatcctcgaggtggaccgcaccgaggccaagagcgccctgaaggacggctccaagatcaagcacgcggtgagccgggggtccagcaagatccgctggatcgtcgagcgcggcatggtgaagcccaaggggaaggtggtcgacctgggctgcgggcggggcggctggagctactacatggccaccctcaagaacgtgaccgaggtgaaggggtacaccaagggcgggccgggccacgaggagcccatccccatggccacgtacgggtggaacctggtcaagctgcactccggcgtggacgtgttctacaagcccaccgagcaggtcgacaccctcctgtgcgacatcggcgagagctccagcaacccgaccatcgaggaggggcgcacgctgcgggtgctcaagatggtggagccctggctgtccagcaagcccgagttctgcatcaaggtcctgaacccctacatgccgaccgtgatcgaggagctggagaagctccagcgcaagcacggcgggaacctggtccggtgccccctgtcccgcaacagcacccacgagatgtactgggtgtccggcgccagcggcaacatcgtgtccagcgtcaacaccacgtccaagatgctcctgaaccggttcaccacccgccaccggaagcccacctacgagaaggacgtggacctgggggcgggcacgcgcagcgtgtccaccgagaccgagaagcccgacatgaccatcatcgggcggcgcctccagcggctgcaggaggagcacaaggagacgtggcactacgaccaggagaacccgtaccgcacctgggcctaccacggcagctacgaggccccctccaccgggagcgcctccagcatggtcaacggcgtggtgaagctgctcaccaagccctgggacgtcatcccgatggtgacgcagctggccatgaccgacaccacccccttcggccagcagcgggtgttcaaggagaaggtcgacacgcgcaccccccagcccaagccggggacccggatggtgatgaccacgaccgcgaactggctgtgggccctcctgggcaagaagaagaacccccgcctgtgcacccgggaggagttcatcagcaaggtgcgctccaacgccgccatcggggccgtcttccaggaggagcagggctggaccagcgcgtccgaggccgtgaacgacagccggttctgggagctcgtggacaaggagcgcgccctgcaccaggaggggaagtgcgagtcctgcgtctacaacatgatgggcaagcgcgagaagaagctgggcgagttcgggcgggccaagggcagccgcgccatctggtacatgtggctcggggcgcggttcctggagttcgaggccctgggcttcctcaacgaggaccactggttcgggcgcgagaactcctggagcggcgtggagggcgaggggctgcaccggctgggctacatcctcgaggagatcgacaagaaggacggggacctgatgtacgccgacgacacggccggctgggacacccgcatcaccgaggacgacctgcagaacgaggagctcatcaccgagcagatggcgccccaccacaagatcctggccaaggccatcttcaagctgacgtaccagaacaaggtggtcaaggtgctccggcccaccccgcgcggcgccgtgatggacatcatctcccggaaggaccagcgcgggagcggccaggtcgggacctacggcctgaacaccttcaccaacatggaggtgcagctgatccggcagatggaggccgagggggtgatcacgcaggacgacatgcagaaccccaagggcctcaaggagcgcgtcgagaagtggctgcgggagtgcggcgtggaccgcctgaagcggatggcgatctccggggacgactgcgtggtcaagcccctcgacgagcgcttcggcaccagcctgctgttcctcaacgacatggggaaggtgcggaaggacatcccccagtgggagccgtccaagggctggaagaactggcaggaggtgcccttctgcagccaccacttccacaagatcttcatgaaggacgggcgctccctggtcgtgccctgccggaaccaggacgagctgatcggccgcgcccgcatcagccagggcgccgggtggtccctccgggagaccgcctgcctgggcaaggcctacgcgcagatgtggagcctgatgtacttccaccgccgggacctccgcctggccagcatggccatctgctccgccgtgcccaccgagtggttcccgacgagccggaccacctggtccatccacgcccaccaccagtggatgaccacggaggacatgctgaaggtctggaaccgcgtgtggatcgaggacaaccccaacatgatcgacaagacccccgtgcacagctgggaggacatcccctacctcgggaagcgggaggacctgtggtgcggctccctgatcgggctcagctcccgcgcgacctgggccaagaacatccacaccgccatcacgcaggtccggaacctgatcggcaaggaggagtacgtggactacatgccggtgatgaagcgctacagcgccccctccgagagcgagggcgtcctgtga

SEQ ID NO: 10445 - RNA, 9867 nt, synthetic construct
  misc_feature 1..9867: note = derived and/or modified CDS sequence (opt1) from DENV-4__GQ199882__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctctccgagaaggaggagaacatggtgaagagccaggtcgccgccggccagggcacgtccgagaccttcagcatggggctgctgtgcctcaccctgttcgtggaggagtgcctgcggcgccgggtgacccgcaagcacatgatcctcgcggtcgtgatcacgctgtgcgccatcatcctgggcgggctcacctggatggacctgctgcgggccctcatcatgctgggcgacaccatgtccggccgcatcgggggccagacccacctggccatcatggccgtgttcaagatgagccccgggtacgtcctcggcgtgttcctgcggaagctgacgtcccgcgagaccgcgctcatggtgatcgggatggccatgaccaccacgctgagcatcccgcacgacctgatggagctcatcgacggcatctccctgggcctgatcctcctgaagatcgtcacccagttcgacaacacccaggtggggaccctggccctcagcctgacgttcatccggtccaccatgagcctggtgatggcctggcgcaccatcatggccgtcctcttcgtggtgaccctgatccccctgtgccggacgtcctgcctccagaagcagagccactgggtcgagatcaccgcgctgatcctgggcgcccaggccctccccgtgtacctgatgaccctgatgaagggggcctcccgccggagctggcccctcaacgagggcatcatggcggtggggctggtctccctgctcggcagcgccctgctgaagaacgacgtgccgctcgccggccccatggtggccgggggcctgctgctcgccgcgtacgtcatgagcgggtccagcgccgacctgtccctggagaaggccgccaacgtgcagtgggacgagatggccgacatcaccggcagctcccccatcatcgaggtgaagcaggacgaggacgggagcttctccatccgcgacgtcgaggagacgaacatgatcaccctcctggtgaagctggcgctcatcaccgtgagcggcctgtaccccctggccatcccggtcaccatgacgctctggtacatgtggcaggtgaagacccagcggtccggcgccctgtgggacgtgcccagccccgccgccacccagaaggcggccctgtccgagggggtctaccgcatcatgcagcggggcctcttcgggaagacccaggtgggcgtggggatccacatggagggcgtcttccacaccatgtggcacgtgacgcgcggcagcgtgatctgccacgagaccgggcggctggagccctcctgggccgacgtccgcaacgacatgatcagctacggcgggggctggcgcctgggcgacaagtgggacaaggaggaggacgtgcaggtgctcgccatcgagccggggaagaaccccaagcacgtccagaccaagcccggcctgttcaagaccctgacgggggagatcggcgccgtgaccctcgacttcaagcccgggacctccggcagcccgatcatcaaccggaagggcaaggtgatcgggctgtacggcaacggggtcgtgaccaagtccggcgactacgtgagcgcgatcacgcaggccgagcgcatcggggagcccgactacgaggtcgacgaggacatcttccggaagaagcgcctgaccatcatggacctccaccccggcgccggcaagaccaagcggatcctgccgtccatcgtgcgcgaggccctgaagcggcgcctgcggaccctcatcctggcgcccacgcgcgtggtcgccgccgagatggaggaggccctgcgggggctccccatccgctaccagacccccgccgtgaagagcgagcacaccggccgggagatcgtggacctgatgtgccacgcgaccttcacgacccgcctgctcagctccacccgggtcccgaactacaacctgatcgtgatggacgaggcccacttcaccgaccccagctccgtcgccgcccgcgggtacatcagcacgcgggtggagatgggcgaggccgcggccatcttcatgaccgccaccccccccggggccaccgacccgttcccccagtccaacagccccatcgaggacatcgagcgcgagatccccgagcggtcctggaacacgggcttcgactggatcaccgactaccagggcaagaccgtgtggttcgtcccgagcatcaaggccgggaacgacatcgcgaactgcctgcgcaagtccggcaagaaggtgatccagctcagccgcaagaccttcgacacggagtaccccaagaccaagctgaccgactgggacttcgtggtcaccacggacatctccgagatgggggccaacttccgggccggccgcgtgatcgacccccggcgctgcctgaagcccgtgatcctcaccgacgggagcgagcgggtcatcctggccggcccgatccccgtgacccccgcgtccgccgcccagcgccggggccgcatcgggcggaaccccgcccaggaggacgaccagtacgtgttcagcggcgacccgctgaagaacgacgaggaccacgcccactggaccgaggcgaagatgctcctggacaacatctacacgcccgaggggatcatccccaccctgttcggccccgagcgcgagaagacccaggccatcgacggcgagttccggctccgcggggagcagcggaagaccttcgtcgagctgatgcgccggggcgacctgccggtgtggctctcctacaaggtggccagcgccgggatctcctacaaggaccgcgagtggtgcttcacgggcgagcggaacaaccagatcctggaggagaacatggaggtcgagatctggacccgcgagggggagaagaagaagctgcggccccgctggctcgacgcccgggtgtacgcggaccccatggccctgaaggacttcaaggagttcgccagcggccgcaagtccatcaccctggacatcctcaccgagatcgccagcctgcccacctacctgagctcccgcgccaagctcgcgctggacaacatcgtgatgctgcacacgaccgagcggggcgggcgcgcctaccagcacgccctcaacgagctgccggagagcctggagaccctcatgctggtcgccctgctcggcgcgatgaccgccgggatcttcctgttcttcatgcagggcaaggggatcggcaagctgtccatgggcctcatcacgatcgccgtggccagcgggctgctgtgggtggccgagatccagccccagtggatcgcggcctccatcatcctcgagttcttcctgatggtcctgctcatccccgagccggagaagcagcggaccccccaggacaaccagctgatctacgtgatcctgaccatcctcaccatcatcggcctgatcgccgccaacgagatggggctgatcgagaagacgaagaccgacttcggcttctaccaggtgaagaccgagaccacgatcctcgacgtcgacctgcgccccgccagcgcgtggaccctgtacgccgtggccaccaccatcctcacgcccatgctgcggcacaccatcgagaacacctccgccaacctgagcctcgccgcgatcgccaaccaggccgccgtgctgatggggctgggcaagggctggccgctccaccgcatggacctgggggtccccctgctcgccatgggctgctactcccaggtgaaccccaccacgctgaccgcgagcctggtgatgctcctggtccactacgccatcatcgggcccggcctgcaggccaaggccacccgggaggcgcagaagcgcaccgccgccggcatcatgaagaacccgacggtggacgggatcaccgtgatcgacctcgagcccatctcctacgaccccaagttcgagaagcagctgggccaggtcatgctgctcgtgctgtgcgccgggcagctgctcctgatgcggaccacctgggccttctgcgaggtgctgacgctcgcgaccggccccatcctgaccctgtgggaggggaacccgggccgcttctggaacaccacgatcgccgtcagcaccgccaacatcttccggggctcctacctcgccggggccggcctggcgttcagcctgatcaagaacgcccagaccccccgccgggggaccggcacgaccggggagaccctcggcgagaagtggaagcgccagctgaactccctggaccggaaggagttcgaggagtacaagcgcagcggcatcctcgaggtggaccggaccgaggccaagtccgccctgaaggacgggagcaagatcaagcacgccgtgtcccgcggcagcagcaagatccggtggatcgtcgagcgcgggatggtgaagcccaagggcaaggtggtcgacctggggtgcggccgcggcgggtggtcctactacatggcgaccctcaagaacgtgacggaggtgaagggctacaccaaggggggccccgggcacgaggagccgatccccatggccacctacggctggaacctggtcaagctgcacagcggcgtggacgtgttctacaagcccaccgagcaggtcgacacgctcctgtgcgacatcggggagtccagctccaaccccaccatcgaggagggccggaccctgcgcgtgctcaagatggtggagccgtggctgagctccaagcccgagttctgcatcaaggtcctgaacccctacatgcccaccgtgatcgaggagctggagaagctccagcggaagcacgggggcaacctggtccgctgcccgctgagccggaactccacgcacgagatgtactgggtgagcggcgcctccgggaacatcgtgagctccgtcaacaccaccagcaagatgctcctgaaccgcttcaccacgcggcaccgcaagcccacctacgagaaggacgtggacctgggcgccgggacccggtccgtgagcaccgagacggagaagcccgacatgaccatcatcggccgccggctccagcgcctgcaggaggagcacaaggagacctggcactacgaccaggagaacccctaccggacctgggcgtaccacgggtcctacgaggccccgagcacgggctccgccagcagcatggtcaacggcgtggtgaagctgctcaccaagccctgggacgtcatccccatggtgacccagctggccatgaccgacacgaccccgttcgggcagcagcgcgtgttcaaggagaaggtcgacacccggaccccccagcccaagcccggcacgcgcatggtgatgaccaccaccgccaactggctgtgggcgctcctggggaagaagaagaacccgcggctgtgcacgcgcgaggagttcatctccaaggtgcggagcaacgccgccatcggcgccgtcttccaggaggagcaggggtggacctccgccagcgaggcggtgaacgactcccgcttctgggagctcgtggacaaggagcgggccctgcaccaggagggcaagtgcgagagctgcgtctacaacatgatgggcaagcgcgagaagaagctgggggagttcggccgcgccaaggggtcccgggccatctggtacatgtggctcggcgcccgcttcctggagttcgaggcgctggggttcctcaacgaggaccactggttcggccgggagaacagctggtccggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggccccccaccacaagatcctggcgaaggccatcttcaagctgacctaccagaacaaggtggtcaaggtgctccgccccaccccccggggggccgtgatggacatcatcagccgcaaggaccagcggggctccgggcaggtcggcacctacgggctgaacacgttcaccaacatggaggtgcagctgatccgccagatggaggccgagggcgtgatcacccaggacgacatgcagaacccgaagggcctcaaggagcgggtcgagaagtggctgcgcgagtgcggggtggaccggctgaagcgcatggccatcagcggcgacgactgcgtggtcaagcccctcgacgagcggttcgggacctccctgctgttcctcaacgacatgggcaaggtgcgcaaggacatcccccagtgggagcccagcaaggggtggaagaactggcaggaggtgccgttctgctcccaccacttccacaagatcttcatgaaggacggccggagcctggtcgtgccctgccgcaaccaggacgagctgatcggccgggcgcgcatctcccagggggccggctggagcctccgcgagacggcctgcctggggaaggcctacgcccagatgtggagcctgatgtacttccaccggcgcgacctccggctggcgtccatggccatctgcagcgccgtgcccaccgagtggttccccacctcccgcaccacgtggagcatccacgcccaccaccagtggatgaccaccgaggacatgctgaaggtctggaaccgggtgtggatcgaggacaacccgaacatgatcgacaagacccccgtgcactcctgggaggacatcccctacctcggcaagcgcgaggacctgtggtgcgggagcctgatcggcctctccagccgggccacgtgggcgaagaacatccacaccgccatcacccaggtccgcaacctgatcggcaaggaggagtacgtggactacatgcccgtgatgaagcggtactccgccccgagcgagtccgagggggtcctgtga

SEQ ID NO: 10446 - RNA, 9867 nt, synthetic construct
  misc_feature 1..9867: note = derived and/or modified CDS sequence (opt1) from DENV-4__GQ199883__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgccgaggtgaagctgccggactacggcgagctgaccctcgactgcgagccccggagcgggatcgacttcaacgagatgatcctgatgaagatgaagaagaagacctggctggtccacaagcagtggttcctcgacctgcccctgccctggaccgcgggcgccgacacctccgaggtgcactggaactacaaggagcgcatggtgacgttcaaggtcccgcacgccaagcggcaggacgtgaccgtgctcgggagccaggagggcgccatgcacagcgccctggcgggcgccaccgaggtcgactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatctccagcacccccctggccgagaacacgaactccgtgaccaacatcgagctggagccgcccttcggggacagctacatcgtgatcggcgtcggcaactccgccctcaccctgcactggttccggaaggggagctccatcggcaagatgttcgagagcacctaccgcggggccaagcggatggcgatcctgggcgagacggcctgggacttcgggtccgtgggcggcctcttcaccagcctggggaaggccgtgcaccaggtcttcggctccgtgtacaccaccatgttcgggggcgtgagctggatgatccgcatcctgatcgggttcctcgtcctgtggatcggcacgaactcccggaacaccagcatggccatgacctgcatcgccgtgggcgggatcaccctgttcctgggcttcacggtgcaggcggacatggggtgcgtcgtgtcctggagcggccgcgagctcaagtgcgggagcggcatcttcgtggtcgacaacgtgcacacctggaccgagcagtacaagttccagcccgagtcccccgcccggctggccagcgccatcctgaacgcccacaaggacggcgtgtgcgggatccgctccaccacgcggctcgagaacgtcatgtggaagcagatcaccaacgagctgaactacgtgctgtgggagggcgggcacgacctcaccgtggtcgcgggcgacgtgaagggcgtgctgaccaaggggaagcgcgccctgacgccgcccgtcagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacctggcagatcgagaaggcgagcctgatcgaggtgaagacgtgcctgtggcccaagacccacaccctctggtccaacggggtgctggagagccagatgctgatccccaagtcctacgccggcccgttcagccagcacaactaccgccaggggtacgccacccagaccgtcggcccctggcacctcgggaagctggagatcgacttcggcgagtgccccggcacgaccgtgaccatccaggaggactgcgaccaccgggggcccagcctgcgcaccacgaccgcctccggcaagctcgtgacccagtggtgctgccgcagctgcaccatgccgcccctgcggttcctgggggaggacggctgctggtacgggatggagatccgccccctctccgagaaggaggagaacatggtcaagagccaggtggccgcgggccagggcacgtccgagaccttcagcatggggctgctgtgcctcaccctgttcgtcgaggagtgcctgcggcgccgggtgacccgcaagcacatgatcctcgccgtggtcatcacgctgtgcgccatcatcctgggcgggctcacctggatggacctgctgcgggccctcatcatgctgggcgacaccatgtccggccgcatcgggggccagacccacctggccatcatggcggtgttcaagatgagccccgggtacgtgctcggcgtcttcctgcggaagctgacgtcccgcgagaccgccctcatggtgatcgggatggccatgaccaccacgctgagcatcccgcacgacctgatggagctcatcgacggcatctccctgggcctgatcctcctgaagatcgtgacccagttcgacaacacccaggtcgggaccctggccctcagcctgacgttcatccggtccaccatgagcctggtgatggcctggcgcaccatcatggcggtgctcttcgtcgtgaccctgatccccctgtgccggacgtcctgcctccagaagcagagccactgggtggagatcaccgccctgatcctgggcgcccaggccctccccgtctacctgatgaccctgatgaagggggcgtcccgccggagctggcccctcaacgagggcatcatggccgtggggctggtgtccctgctcggcagcgccctgctgaagaacgacgtcccgctcgccggccccatggtggccgggggcctgctgctcgcggcctacgtgatgagcgggtccagcgccgacctgtccctggagaaggccgccaacgtccagtgggacgagatggcggacatcaccggcagctcccccatcatcgaggtgaagcaggacgaggacgggagcttctccatccgcgacgtggaggagacgaacatgatcaccctcctggtcaagctggccctcatcaccgtgagcggcctgtaccccctggccatcccggtgaccatgacgctctggtacatgtggcaggtcaagacccagcggtccggcgccctgtgggacgtgcccagccccgccgcgacccagaaggccgccctgtccgagggggtgtaccgcatcatgcagcggggcctcttcgggaagacccaggtcggcgtggggatccacatggagggcgtgttccacaccatgtggcacgtcacgcgcggcagcgtgatctgccacgagaccgggcggctggagccctcctgggccgacgtgcgcaacgacatgatcagctacggcgggggctggcgcctgggcgacaagtgggacaaggaggaggacgtccaggtgctcgccatcgagccggggaagaaccccaagcacgtgcagaccaagcccggcctgttcaagaccctgacgggggagatcggcgcggtcaccctcgacttcaagcccgggacctccggcagcccgatcatcaaccggaagggcaaggtgatcgggctgtacggcaacggggtggtcaccaagtccggcgactacgtgagcgccatcacgcaggccgagcgcatcggggagcccgactacgaggtggacgaggacatcttccggaagaagcgcctgaccatcatggacctccaccccggcgccggcaagaccaagcggatcctgccgtccatcgtccgcgaggcgctgaagcggcgcctgcggaccctcatcctggcccccacgcgcgtggtggccgccgagatggaggaggccctgcgggggctccccatccgctaccagacccccgcggtcaagagcgagcacaccggccgggagatcgtggacctgatgtgccacgccaccttcacgacccgcctgctcagctccacccgggtgccgaactacaacctgatcgtcatggacgaggcccacttcaccgaccccagctccgtggccgcccgcgggtacatcagcacgcgggtcgagatgggcgaggcggccgccatcttcatgaccgccaccccccccggggccaccgacccgttcccccagtccaacagccccatcgaggacatcgagcgcgagatccccgagcggtcctggaacacgggcttcgactggatcaccgactaccagggcaagaccgtgtggttcgtgccgagcatcaaggcggggaacgacatcgccaactgcctgcgcaagtccggcaagaaggtcatccagctcagccgcaagaccttcgacacggagtaccccaagaccaagctgaccgactgggacttcgtggtgaccacggacatctccgagatgggggccaacttccgggccggccgcgtcatcgacccccggcgctgcctgaagcccgtgatcctcaccgacgggccggagcgggtgatcctggcgggccccatccccgtcacccccgccagcgccgcccagcgccggggccgcatcgggcggaacccggcccaggaggacgaccagtacgtgttctccggcgaccccctgaagaacgacgaggaccacgcgcactggaccgaggccaagatgctcctggacaacatctacacgcccgaggggatcatccccaccctgttcggcccggagcgcgagaagacccaggccatcgacggcgagttccggctccgcggggagcagcggaagaccttcgtggagctgatgcgccggggcgacctgcccgtctggctcagctacaaggtggcctccgccgggatcagctacaaggaccgcgagtggtgcttcacgggcgagcggaacaaccagatcctggaggagaacatggaggtggagatctggacccgcgagggggagaagaagaagctgcggccccgctggctcgacgcgcgggtctacgccgaccccatggccctgaaggacttcaaggagttcgcctccggccgcaagagcatcaccctggacatcctcaccgagatcgcctccctgccgacctacctgagcagccgcgcgaagctcgccctggacaacatcgtgatgctgcacacgaccgagcggggcgggcgcgcctaccagcacgccctcaacgagctgcccgagtccctggagaccctcatgctggtggcgctgctcggcgccatgaccgccgggatcttcctgttcttcatgcagggcaaggggatcggcaagctgagcatgggcctcatcacgatcgccgtcgcctccgggctgctgtgggtggcggagatccagccccagtggatcgccgccagcatcatcctcgagttcttcctgatggtgctgctcatcccggagcccgagaagcagcggaccccccaggacaaccagctgatctacgtcatcctggccatcctcaccatcatcggcctgatcgccgcgaacgagatggggctgatcgagaagaccaagacggacttcggcttctaccaggtgaagaccgagaccaccatcctcgacgtggacctgcgccccgcctccgcctggacgctgtacgccgtcgccaccaccatcctcaccccgatgctgcggcacacgatcgagaacaccagcgcgaacctgtccctcgccgccatcgccaaccaggccgcggtgctgatggggctgggcaagggctggcccctccaccgcatggacctgggggtgcccctgctcgccatgggctgctacagccaggtcaaccccaccaccctgacggcctccctggtgatgctcctggtgcactacgccatcatcgggccgggcctgcaggcgaaggccacccgggaggcccagaagcgcaccgccgccggcatcatgaagaaccccaccgtcgacgggatcacggtgatcgacctcgagcccatcagctacgaccccaagttcgagaagcagctgggccaggtgatgctgctcgtcctgtgcgcggggcagctgctcctgatgcggaccacctgggccttctgcgaggtgctgaccctcgccacgggcccgatcctgaccctgtgggaggggaaccccggccgcttctggaacaccaccatcgccgtgtccacggccaacatcttccggggcagctacctcgcgggggccggcctggccttctccctgatcaagaacgcccagaccccccgccgggggaccggcaccacgggggagaccctcggcgagaagtggaagcgccagctgaacagcctggaccggaaggagttcgaggagtacaagcgctccggcatcctcgaggtcgaccggaccgaggccaagagcgcgctgaaggacgggtccaagatcaagcacgccgtgagccgcggctccagcaagatccggtggatcgtggagcgcgggatggtcaagcccaagggcaaggtggtggacctggggtgcggccgcggcgggtggagctactacatggccaccctcaagaacgtcaccgaggtgaagggctacacgaaggggggcccggggcacgaggagcccatccccatggccacctacggctggaacctggtgaagctgcactccggcgtcgacgtgttctacaagcccaccgagcaggtggacaccctcctgtgcgacatcggggagagctccagcaacccgacgatcgaggagggccggaccctgcgcgtcctcaagatggtggagccctggctgtccagcaagcccgagttctgcatcaaggtgctgaacccctacatgccgaccgtcatcgaggagctggagaagctccagcggaagcacgggggcaacctggtgcgctgccccctgtcccggaacagcacccacgagatgtactgggtctccggcgcgagcgggaacatcgtgtccagcgtgaacacgacctccaagatgctcctgaaccgcttcaccacccggcaccgcaagcccacgtacgagaaggacgtcgacctgggcgccgggacccggagcgtgtccaccgagaccgagaagcccgacatgacgatcatcggccgccggctccagcgcctgcaggaggagcacaaggagacctggcactacgaccaggagaacccgtaccggacctgggcctaccacgggagctacgaggccccctccaccggcagcgcctccagcatggtgaacggcgtcgtgaagctgctcacgaagccctgggacgtgatcccgatggtcacccagctggcgatgaccgacaccacgcccttcgggcagcagcgcgtgttcaaggagaaggtggacacccggaccccccagcccaagccgggcacccgcatggtcatgacgaccaccgccaactggctgtgggccctcctggggaagaagaagaacccccggctgtgcacccgcgaggagttcatcagcaaggtgcggtccaacgccgccatcggcgcggtgttccaggaggagcaggggtggacgagcgcctccgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggcgatctggtacatgtggctcggcgcccgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgccgacgacaccgcgggctgggacacccggatcaccgaggacgacctgcagaacgaggagctcatcacggagcagatggccccccaccacaagatcctggccaaggccatcttcaagctgacctaccagaacaaggtggtgaaggtcctccgccccaccccgcggggggccgtgatggacatcatctcccgcaaggaccagcggggcagcgggcaggtgggcacctacgggctgaacaccttcacgaacatggaggtccagctgatccgccagatggaggcggagggcgtgatcacccaggacgacatgcagaaccccaagggcctcaaggagcgggtggagaagtggctgcgcgagtgcggggtcgaccggctgaagcgcatggccatctccggcgacgactgcgtggtgaagcccctcgacgagcggttcgggaccagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggccggctggtccctccgcgagaccgcctgcctggggaaggcgtacgcccagatgtggagcctgatgtacttccaccggcgcgacctccggctggccagcatggccatctgctccgccgtgcccacggagtggttcccgaccagccgcaccacctggtccatccacgcgcaccaccagtggatgacgaccgaggacatgctgaaggtgtggaaccgggtctggatcgaggacaaccccaacatgatcgacaagacccccgtgcacagctgggaggacatcccctacctcggcaagcgcgaggacctgtggtgcgggtccctgatcggcctcagctcccgggccacctgggccaagaacatccacacggccatcacccaggtgcgcaacctgatcggcaaggaggagtacgtcgactacatgccggtgatgaagcggtacagcgccccctccgagagcgagggggtgctgtga

SEQ ID NO: 10447 - RNA, 9867 nt, synthetic construct
  misc_feature 1..9867: note = derived and/or modified CDS sequence (opt1) from DENV-4__GQ199884__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctctccgagaaggaggagaacatggtgaagagccaggtcgccgccggccagggcacgtccgagaccttcagcatggggctgctgtgcctcaccctgttcgtggaggagtgcctgcggcgccgggtgacccgcaagcacatgatcctcgcggtcgtgatcacgctgtgcgccatcatcctgggcgggctcacctggatggacctgctgcgggccctcatcatgctgggcgacaccatgtccggccgcatcgggggccagacccacctggccatcatggccgtgttcaagatgagccccgggtacgtcctcggcgtgttcctgcggaagctgacgtcccgcgagaccgcgctcatggtgatcgggatggccatgaccaccacgctgagcatcccgcacgacctgatggagctcatcgacggcatctccctgggcctgatcctcctgaagatcgtcacccagttcgacaacacccaggtggggaccctggccctcagcctgacgttcatccggtccaccatgagcctggtgatggcctggcgcaccatcatggccgtcctcttcgtggtgaccctgatccccctgtgccggacgtcctgcctccagaagcagagccactgggtcgagatcaccgcgctgatcctgggcgcccaggccctccccgtgtacctgatgaccctgatgaagggggcctcccgccggagctggcccctcaacgagggcatcatggcggtggggctggtctccctgctcggcagcgccctgctgaagaacgacgtgccgctcgccggccccatggtggccgggggcctgctgctcgccgcgtacgtcatgagcgggtccagcgccgacctgtccctggagaaggccgccaacgtgcagtgggacgagatggccgacatcaccggcagctcccccatcatcgaggtgaagcaggacgaggacgggagcttctccatccgcgacgtcgaggagacgaacatgatcaccctcctggtgaagctggcgctcatcaccgtgagcggcctgtaccccctggccatcccggtcaccatgacgctctggtacatgtggcaggtgaagacccagcggtccggcgccctgtgggacgtgcccagccccgccgccacccagaaggcggccctgtccgagggggtctaccgcatcatgcagcggggcctcttcgggaagacccaggtgggcgtggggatccacatggagggcgtcttccacaccatgtggcacgtgacgcgcggcagcgtgatctgccacgagaccgggcggctggagccctcctgggccgacgtccgcaacgacatgatcagctacggcgggggctggcgcctgggcgacaagtgggacaaggaggaggacgtgcaggtgctcgccatcgagccggggaagaaccccaagcacgtccagaccaagcccggcctgttcaagaccctgacgggggagatcggcgccgtgaccctcgacttcaagcccgggacctccggcagcccgatcatcaaccggaagggcaaggtgatcgggctgtacggcaacggggtcgtgaccaagtccggcgactacgtgagcgcgatcacgcaggccgagcgcatcggggagcccgactacgaggtcgacgaggacatcttccggaagaagcgcctgaccatcatggacctccaccccggcgccggcaagaccaagcggatcctgccgtccatcgtgcgcgaggccctgaagcggcgcctgcggaccctcatcctggcgcccacgcgcgtggtcgccgccgagatggaggaggccctgcgggggctccccatccgctaccagacccccgccgtgaagagcgagcacaccggccgggagatcgtggacctgatgtgccacgcgaccttcacgacccgcctgctcagctccacccgggtcccgaactacaacctgatcgtgatggacgaggcccacttcaccgaccccagctccgtcgccgcccgcgggtacatcagcacgcgggtggagatgggcgaggccgcggccatcttcatgaccgccaccccccccggggccaccgacccgttcccccagtccaacagccccatcgaggacatcgagcgcgagatccccgagcggtcctggaacacgggcttcgactggatcaccgactaccagggcaagaccgtgtggttcgtcccgagcatcaaggccgggaacgacatcgcgaactgcctgcgcaagtccggcaagaaggtgatccagctcagccgcaagaccttcgacacggagtaccccaagaccaagctgaccgactgggacttcgtggtcaccacggacatctccgagatgggggccaacttccgggccggccgcgtgatcgacccccggcgctgcctgaagcccgtgatcctcaccgacgggccggagcgggtcatcctggccggccccatccccgtgacccccgcgagcgccgcccagcgccggggccgcatcgggcggaacccggcccaggaggacgaccagtacgtgttctccggcgaccccctgaagaacgacgaggaccacgcccactggaccgaggcgaagatgctcctggacaacatctacacgcccgaggggatcatccccaccctgttcggcccggagcgcgagaagacccaggccatcgacggcgagttccggctccgcggggagcagcggaagaccttcgtcgagctgatgcgccggggcgacctgcccgtgtggctcagctacaaggtggcctccgccgggatcagctacaaggaccgcgagtggtgcttcacgggcgagcggaacaaccagatcctggaggagaacatggaggtcgagatctggacccgcgagggggagaagaagaagctgcggccccgctggctcgacgcccgggtgtacgcggaccccatggccctgaaggacttcaaggagttcgcctccggccgcaagagcatcaccctggacatcctcaccgagatcgcctccctgccgacctacctgagcagccgcgccaagctcgcgctggacaacatcgtgatgctgcacacgaccgagcggggcgggcgcgcctaccagcacgccctcaacgagctgcccgagtccctggagaccctcatgctggtcgccctgctcggcgcgatgaccgccgggatcttcctgttcttcatgcagggcaaggggatcggcaagctgagcatgggcctcatcacgatcgccgtggcctccgggctgctgtgggtggccgagatccagccccagtggatcgcggccagcatcatcctcgagttcttcctgatggtcctgctcatcccggagcccgagaagcagcggaccccccaggacaaccagctgatctacgtgatcctggccatcctcaccatcatcggcctgatcgccgccaacgagatggggctgatcgagaagaccaagacggacttcggcttctaccaggtgaagaccgagaccaccatcctcgacgtcgacctgcgccccgcgtccgcctggacgctgtacgccgtggccaccaccatcctcaccccgatgctgcggcacacgatcgagaacaccagcgccaacctgtccctcgcggccatcgccaaccaggccgccgtgctgatggggctgggcaagggctggcccctccaccgcatggacctgggggtccccctgctcgcgatgggctgctacagccaggtgaaccccaccaccctgacggcctccctggtgatgctcctggtccactacgccatcatcgggccgggcctgcaggccaaggcgacccgggaggcccagaagcgcaccgccgccggcatcatgaagaaccccaccgtggacgggatcacggtgatcgacctcgagcccatcagctacgaccccaagttcgagaagcagctgggccaggtcatgctgctcgtgctgtgcgccgggcagctgctcctgatgcggaccacctgggcgttctgcgaggtgctgaccctcgccacgggcccgatcctgaccctgtgggaggggaaccccggccgcttctggaacaccaccatcgccgtctccacggccaacatcttccggggcagctacctcgccggggcgggcctggccttctccctgatcaagaacgcccagaccccccgccgggggaccggcaccacgggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtgagccgcggctccagcaagatccggtggatcgtcgagcgcgggatggtgaagcccaagggcaaggtggtcgacctggggtgcggccgcggcgggtggagctactacatggccaccctcaagaacgtgaccgaggtgaagggctacacgaaggggggcccggggcacgaggagcccatccccatggccacctacggctggaacctggtcaagctgcactccggcgtggacgtgttctacaagcccaccgagcaggtcgacaccctcctgtgcgacatcggggagagctccagcaacccgacgatcgaggagggccggaccctgcgcgtgctcaagatggtggagccctggctgtccagcaagcccgagttctgcatcaaggtcctgaacccctacatgccgaccgtgatcgaggagctggagaagctccagcggaagcacgggggcaacctggtccgctgccccctgtcccggaacagcacccacgagatgtactgggtgtccggcgccagcgggaacatcgtgtccagcgtcaacacgacctccaagatgctcctgaaccgcttcaccacccggcaccgcaagcccacgtacgagaaggacgtggacctgggcgcggggacccggagcgtgtccaccgagaccgagaagcccgacatgacgatcatcggccgccggctccagcgcctgcaggaggagcacaaggagacctggcactacgaccaggagaacccgtaccggacctgggcctaccacgggagctacgaggccccctccaccggcagcgcctccagcatggtcaacggcgtggtgaagctgctcacgaagccctgggacgtcatcccgatggtgacccagctggccatgaccgacaccacgcccttcgggcagcagcgcgtgttcaaggagaaggtcgacacccggaccccccagcccaagccgggcacccgcatggtgatgacgaccaccgcgaactggctgtgggccctcctggggaagaagaagaacccccggctgtgcacccgcgaggagttcatcagcaaggtgcggtccaacgccgccatcggcgccgtcttccaggaggagcaggggtggacgagcgcgtccgaggccgtgaacgacagccgcttctgggagctcgtggacaaggagcgggccctgcaccaggagggcaagtgcgagtcctgcgtctacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcaccgaggacgacctgcagaacgaggagctcatcacggagcagatggcgccccaccacaagatcctggccaaggccatcttcaagctgacctaccagaacaaggtggtcaaggtgctccgccccaccccgcggggggccgtgatggacatcatctcccgcaaggaccagcggggcagcgggcaggtcggcacctacgggctgaacaccttcacgaacatggaggtgcagctgatccgccagatggaggccgagggcgtgatcacccaggacgacatgcagaaccccaagggcctcaaggagcgggtcgagaagtggctgcgcgagtgcggggtggaccggctgaagcgcatggcgatctccggcgacgactgcgtggtcaagcccctcgacgagcggttcgggaccagcctgctgttcctcaacgacatgggcaaggtgcgcaaggacatcccccagtgggagccgtccaaggggtggaagaactggcaggaggtgcccttctgcagccaccacttccacaagatcttcatgaaggacggccggtccctggtcgtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggccagcatggccatctgctccgccgtgcccacggagtggttcccgaccagccgcaccacctggtccatccacgcccaccaccagtggatgacgaccgaggacatgctgaaggtctggaaccgggtgtggatcgaggacaaccccaacatgatcgacaagacccccgtgcacagctgggaggacatcccctacctcggcaagcgcgaggacctgtggtgcgggtccctgatcggcctcagctcccgggcgacctgggccaagaacatccacacggccatcacccaggtccgcaacctgatcggcaaggaggagtacgtggactacatgccggtgatgaagcggtacagcgccccctccgagagcgagggggtcctgtga

SEQ ID NO: 10448 - RNA, 9867 nt, synthetic construct
  misc_feature 1..9867: note = derived and/or modified CDS sequence (opt1) from DENV-4__FJ882595__SS-prME
  source 1..9867: mol_type = other RNA
agcaccatcaccctgctctgcctgatccccacggccatggccttccacctgtccacccgcgacggcgagccgctcatgatcgtggcgaagcacgagcgggggcgccccctgctgttcaagaccaccgagggcatcaacaagtgcacgctcatcgccatggacctgggggagatgtgcgaggacaccgtcacctacaagtgccccctgctcgtgaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgtccatcagcaacatcacgaccgccacccgctgcccgacccagggggagccctacctcaaggaggagcaggaccagcagtacatctgccggcgcgacgtggtggaccggggctgggggaacggctgcggcctgttcgggaagggcggggtcgtgacgtgcgccaagttctcctgcagcggcaagatcaccgggaacctggtgcagatcgagaacctcgagtacaccgtcgtggtgaccgtccacaacggcgacacgcacgccgtgggcaacgacacctccaaccacggggtcaccgccaccatcacgccccgcagcccctccgtggaggtgaagctgccggactacggcgagctgaccctcgactgcgagccccggagcgggatcgacttcaacgagatgatcctgatgaagatgaagaagaagacctggctggtccacaagcagtggttcctcgacctgcccctgccctggaccgcgggcgccgacacctccgaggtgcactggaactacaaggagcgcatggtgacgttcaaggtcccgcacgccaagcggcaggacgtgaccgtgctcgggagccaggagggcgccatgcacagcgccctggcgggcgccaccgaggtcgactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatctccagcacccccctggccgagaacacgaactccgtgaccaacatcgagctggagccgcccttcggggacagctacatcgtgatcggcgtcggcaactccgccctcaccctgcactggttccggaaggggagctccatcggcaagatgttcgagagcacctaccgcggggccaagcggatggcgatcctgggcgagacggcctgggacttcgggtccgtgggcggcctcttcaccagcctggggaaggccgtgcaccaggtcttcggctccgtgtacaccaccatgttcgggggcgtgagctggatgatccgcatcctgatcgggttcctcgtcctgtggatcggcacgaactcccggaacaccagcatggccatgacctgcatcgccgtgggcgggatcaccctgttcctgggcttcacggtgcaggcggacatggggtgcgtcgtgtcctggagcggccgcgagctcaagtgcgggagcggcatcttcgtggtcgacaacgtgcacacctggaccgagcagtacaagttccagcccgagtcccccgcccggctggccagcgccatcctgaacgcccacaaggacggcgtgtgcgggatccgctccaccacgcggctcgagaacgtcatgtggaagcagatcaccaacgagctgaactacgtgctgtgggagggcgggcacgacctcaccgtggtcgcgggcgacgtgaagggcgtgctgaccaaggggaagcgcgccctgacgccgcccgtcagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacctggcagatcgagaaggcgagcctgatcgaggtgaagacgtgcctgtggcccaagacccacaccctctggtccaacggggtgctggagagccagatgctgatccccaagtcctacgccggcccgttcagccagcacaactaccgccaggggtacgccacccagaccgtcggcccctggcacctcgggaagctggagatcgacttcggcgagtgccccggcacgaccgtgaccatccaggaggactgcgaccaccgggggcccagcctgcgcaccacgaccgcctccggcaagctcgtgacccagtggtgctgccgcagctgcaccatgccgcccctgcggttcctgggggaggacggctgctggtacgggatggagatccgccccctctccgagaaggaggagaacatggtcaagagccaggtggccgcgggccagggcacgtccgagaccttcagcatggggctgctgtgcctcaccctgttcgtcgaggagtgcctgcggcgccgggtgacccgcaagcacatgatcctcgccgtggtcatcacgctgtgcgccatcatcctgggcgggctcacctggatggacctgctgcgggccctcatcatgctgggcgacaccatgtccggccgcatcgggggccagacccacctggccatcatggcggtgttcaagatgagccccgggtacgtgctcggcgtcttcctgcggaagctgacgtcccgcgagaccgccctcatggtgatcgggatggccatgaccaccacgctgagcatcccgcacgacctgatggagctcatcgacggcatctccctgggcctgatcctcctgaagatcgtgacccagttcgacaacacccaggtcgggaccctggccctcagcctgacgttcatccggtccaccatgagcctggtgatggcctggcgcaccatcatggcggtgctcttcgtcgtgaccctgatccccctgtgccggacgtcctgcctccagaagcagagccactgggtggagatcaccgccctgatcctgggcgcccaggccctccccgtctacctgatgaccctgatgaagggggcgtcccgccggagctggcccctcaacgagggcatcatggccgtggggctggtgtccctgctcggcagcgccctgctgaagaacgacgtcccgctcgccggccccatggtggccgggggcctgctgctcgcggcctacgtgatgagcgggtccagcgccgacctgtccctggagaaggccgccaacgtccagtgggacgagatggcggacatcaccggcagctcccccatcatcgaggtgaagcaggacgaggacgggagcttctccatccgcgacgtggaggagacgaacatgatcaccctcctggtcaagctggccctcatcaccgtgagcggcctgtaccccctggccatcccggtgaccatgacgctctggtacatgtggcaggtcaagacccagcggtccggcgccctgtgggacgtgcccagccccgccgcgacccagaaggccgccctgtccgagggggtgtaccgcatcatgcagcggggcctcttcgggaagacccaggtcggcgtggggatccacatggagggcgtgttccacaccatgtggcacgtcacgcgcggcagcgtgatctgccacgagaccgggcggctggagccctcctgggccgacgtgcgcaacgacatgatcagctacggcgggggctggcgcctgggcgacaagtgggacaaggaggaggacgtccaggtgctcgccatcgagccggggaagaaccccaagcacgtgcagaccaagcccggcctgttcaagaccctgacgggggagatcggcgcggtcaccctcgacttcaagcccgggacctccggcagcccgatcatcaaccggaagggcaaggtgatcgggctgtacggcaacggggtggtcaccaagtccggcgactacgtgagcgccatcacgcaggccgagcgcatcggggagcccgactacgaggtggacgaggacatcttccggaagaagcgcctgaccatcatggacctccaccccggcgccggcaagaccaagcggatcctgccgtccatcgtccgcgaggcgctgaagcggcgcctgcggaccctcatcctggcccccacgcgcgtggtggccgccgagatggaggaggccctgcgggggctccccatccgctaccagacccccgcggtcaagagcgagcacaccggccgggagatcgtggacctgatgtgccacgccaccttcacgacccgcctgctcagctccacccgggtgccgaactacaacctgatcgtcatggacgaggcccacttcaccgaccccagctccgtggccgcccgcgggtacatcagcacgcgggtcgagatgggcgaggcggccgccatcttcatgaccgccaccccccccggggccaccgacccgttcccccagtccaacagccccatcgaggacatcgagcgcgagatccccgagcggtcctggaacacgggcttcgactggatcaccgactaccagggcaagaccgtgtggttcgtgccgagcatcaaggcggggaacgacatcgccaactgcctgcgcaagtccggcaagaaggtcatccagctcagccgcaagaccttcgacacggagtaccccaagaccaagctgaccgactgggacttcgtggtgaccacggacatctccgagatgggggccaacttccgggccggccgcgtcatcgacccccggcgctgcctgaagcccgtgatcctcaccgacgggccggagcgggtgatcctggcgggccccatccccgtcacccccgccagcgccgcccagcgccggggccgcatcgggcggaacccggcccaggaggacgaccagtacgtgttctccggcgaccccctgaagaacgacgaggaccacgcgcactggaccgaggccaagatgctcctggacaacatctacacgcccgaggggatcatccccaccctgttcggcccggagcgcgagaagacccaggccatcgacggcgagttccggctccgcggggagcagcggaagaccttcgtggagctgatgcgccggggcgacctgcccgtctggctcagctacaaggtggcctccgccgggatcagctacaaggaccgcgagtggtgcttcacgggcgagcggaacaaccagatcctggaggagaacatggaggtggagatctggacccgcgagggggagaagaagaagctgcggccccgctggctcgacgcgcgggtctacgccgaccccatggccctgaaggacttcaaggagttcgcctccggccgcaagagcatcaccctggacatcctcaccgagatcgcctccctgccgacctacctgagcagccgcgcgaagctcgccctggacaacatcgtgatgctgcacacgaccgagcggggcgggcgcgcctaccagcacgccctcaacgagctgcccgagtccctggagaccctcatgctggtggcgctgctcggcgccatgaccgccgggatcttcctgttcttcatgcagggcacggggatcggcaagctgagcatgggcctcatcaccatcgccgtcgcctccgggctgctgtgggtggcggagatccagccccagtggatcgccgccagcatcatcctcgagttcttcctgatggtgctgctcatcccggagcccgagaagcagcggaccccccaggacaaccagctgatctacgtcatcctgaccatcctcacgatcatcggcctgatcgccgccaacgagatggggctgatcgagaagaccaagaccgacttcggcttctaccaggtgaagaccgagacgaccatcctcgacgtggacctgcgccccgcgtccgcctggaccctgtacgccgtcgccaccacgatcctcaccccgatgctgcggcacaccatcgagaacaccagcgccaacctgtccctcgcggccatcgccaaccaggccgccgtgctgatggggctgggcaagggctggcccctccaccgcatggacctgggggtgcccctgctcgcgatgggctgctacagccaggtcaaccccacgaccctgaccgcctccctggtgatgctcctggtgcactacgccatcatcgggccgggcctgcaggccaaggcgacccgggaggcccagaagcgcacggccgccggcatcatgaagaaccccaccgtcgacgggatcaccgtgatcgacctcgagcccatcagctacgaccccaagttcgagaagcagctgggccaggtgatgctgctcgtcctgtgcgccgggcagctgctcctgatgcggaccacgtgggcgttctgcgaggtgctgaccctcgccaccggcccgatcctgaccctgtgggaggggaaccccggccgcttctggaacacgaccatcgccgtgtccaccgccaacatcttccggggcagctacctcgccggggcgggcctggccttctccctgatcaagaacgcccagaccccccgccgggggacgggcaccaccggggagaccctcggcgagaagtggaagcgccagctgaacagcctggaccggaaggagttcgaggagtacaagcgctccggcatcctcgaggtcgaccggaccgaggccaagagcgccctgaaggacgggtccaagatcaagcacgcggtgagccgcggctccagcaagatccggtggatcgtggagcgcgggatggtcaagcccaagggcaaggtggtggacctggggtgcggccgcggcgggtggagctactacatggccacgctcaagaacgtcaccgaggtgaagggctacaccaaggggggcccggggcacgaggagcccatccccatggccacctacggctggaacctggtgaagctgcactccggcgtcgacgtgttctacaagcccacggagcaggtggacaccctcctgtgcgacatcggggagagctccagcaacccgaccatcgaggagggccggaccctgcgcgtcctcaagatggtggagccctggctgtccagcaagcccgagttctgcatcaaggtgctgaacccctacatgccgacggtcatcgaggagctggagaagctccagcggaagcacgggggcaacctggtgcgctgccccctgtcccggaacagcacccacgagatgtactgggtctccggcgccagcgggaacatcgtgtccagcgtgaacaccacctccaagatgctcctgaaccgcttcacgacccggcaccgcaagcccacctacgagaaggacgtcgacctgggcgcggggacccggagcgtgtccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtcgtgaagctgctcaccaagccctgggacgtgatcccgatggtcacccagctggccatgacggacaccacccccttcgggcagcagcgcgtgttcaaggagaaggtggacacccggacgccccagcccaagccgggcacccgcatggtcatgaccaccacggcgaactggctgtgggccctcctggggaagaagaagaacccccggctgtgcacccgcgaggagttcatcagcaaggtgcggtccaacgccgccatcggcgccgtgttccaggaggagcaggggtggaccagcgcgtccgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtggtgaaggtcctccgccccaccccgcggggggccgtgatggacatcatctcccgcaaggaccagcggggcagcgggcaggtgggcacgtacgggctgaacaccttcaccaacatggaggtccagctgatccgccagatggaggccgagggcgtgatcacccaggacgacatgcagaaccccaagggcctcaaggagcgggtggagaagtggctgcgcgagtgcggggtcgaccggctgaagcgcatggcgatctccggcgacgactgcgtggtgaagcccctcgacgagcggttcgggacgagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggccagcatggccatctgctccgccgtgcccaccgagtggttcccgaccagccgcacgacctggtccatccacgcccaccaccagtggatgaccaccgaggacatgctgaaggtgtggaaccgggtctggatcgaggacaaccccaacatgatcgacaagacgcccgtgcacagctgggaggacatcccctacctcggcaagcgcgaggacctgtggtgcgggtccctgatcggcctcagctcccgggcgacctgggccaagaacatccacaccgccatcacccaggtgcgcaacctgatcggcaaggaggagtacgtcgactacatgccggtgatgaagcggtacagcgccccctccgagagcgagggggtgctgtga

SEQ ID NO: 10449 - RNA, 9867 nt, synthetic construct
  misc_feature 1..9867: note = derived and/or modified CDS sequence (opt1) from DENV-4__FJ882596__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgcgcggcgtcctgaccaaggggaagcgggcgctgacgccgcccgtgagcgacctcaagtactcctggaagacctggggcaaggccaagatcttcacccccgaggcccgcaacagcaccttcctgatcgacgggcccgacacgtccgagtgcccgaacgagcggcgcgcctggaacagcctggaggtggaggactacggcttcgggatgttcaccaccaacatctggatgaagttccgggagggctccagcgaggtctgcgaccaccgcctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccggcaggggtacgccacccagaccgtgggcccctggcacctcgggaagctggagatcgacttcggcgagtgccccggcacgaccgtgaccatccaggaggactgcgaccaccgcgggcccagcctgcgcaccacgaccgcctccggcaagctcgtcacccagtggtgctgccggagctgcaccatgccgcccctgcgcttcctgggggaggacggctgctggtacgggatggagatccggcccctctccgagaaggaggagaacatggtgaagagccaggtcgccgccggccagggcacgtccgagaccttcagcatggggctgctgtgcctcaccctgttcgtggaggagtgcctgcgccggcgcgtgacccggaagcacatgatcctcgcggtcgtgatcacgctgtgcgccatcatcctgggcgggctcacctggatggacctgctgcgcgccctcatcatgctgggcgacaccatgtccggccggatcgggggccagacccacctggccatcatggccgtgttcaagatgagccccgggtacgtcctcggcgtgttcctgcgcaagctgacgtcccgggagaccgcgctcatggtgatcgggatggccatgaccaccacgctgagcatcccgcacgacctgatggagctcatcgacggcatctccctgggcctgatcctcctgaagatcgtcacccagttcgacaacacccaggtggggaccctggccctcagcctgacgttcatccgctccaccatgagcctggtgatggcctggcggaccatcatggccgtcctcttcgtggtgaccctgatccccctgtgccgcacgtcctgcctccagaagcagagccactgggtcgagatcaccgcgctgatcctgggcgcccaggccctccccgtgtacctgatgaccctgatgaagggggcctcccggcgcagctggcccctcaacgagggcatcatggcggtggggctggtctccctgctcggcagcgccctgctgaagaacgacgtgccgctcgccggccccatggtggccgggggcctgctgctcgccgcgtacgtcatgagcgggtccagcgccgacctgtccctggagaaggccgccaacgtgcagtgggacgagatggccgacatcaccggcagctcccccatcatcgaggtgaagcaggacgaggacgggagcttctccatccgggacgtcgaggagacgaacatgatcaccctcctggtgaagctggcgctcatcaccgtgagcggcctgtaccccctggccatcccggtcaccatgacgctctggtacatgtggcaggtgaagacccagcgctccggcgccctgtgggacgtgcccagccccgccgccacccagaaggcggccctgtccgagggggtctaccggatcatgcagcgcggcctcttcgggaagacccaggtgggcgtggggatccacatggagggcgtcttccacaccatgtggcacgtgacgcggggcagcgtgatctgccacgagaccgggcgcctggagccctcctgggccgacgtccgcaacgacatgatcagctacggcgggggctggcggctgggcgacaagtgggacaaggaggaggacgtgcaggtgctcgccatcgagccggggaagaaccccaagcacgtccagaccaagcccggcctgttcaagaccctgacgggggagatcggcgccgtgaccctcgacttcaagcccgggacctccggcagcccgatcatcaaccgcaagggcaaggtgatcgggctgtacggcaacggggtcgtgaccaagtccggcgactacgtgagcgcgatcacgcaggccgagcggatcggggagcccgactacgaggtcgacgaggacatcttccgcaagaagcggctgaccatcatggacctccaccccggcgccggcaagaccaagcgcatcctgccgtccatcgtgcgggaggccctgaagcgccggctgcgcaccctcatcctggcgcccacgcgggtggtcgccgccgagatggaggaggccctgcgcgggctccccatccggtaccagacccccgccgtgaagagcgagcacaccggccgcgagatcgtggacctgatgtgccacgcgaccttcacgacccggctgctcagctccacccgcgtcccgaactacaacctgatcgtgatggacgaggcccacttcaccgaccccagctccgtcgccgcccgggggtacatcagcacgcgcgtggagatgggcgaggccgcggccatcttcatgaccgccaccccccccggggccaccgacccgttcccccagtccaacagccccatcgaggacatcgagcgggagatccccgagcgctcctggaacacgggcttcgactggatcaccgactaccagggcaagaccgtgtggttcgtcccgagcatcaaggccgggaacgacatcgcgaactgcctgcgcaagtccggcaagaaggtgatccagctcagccggaagaccttcgacacggagtaccccaagaccaagctgaccgactgggacttcgtggtcaccacggacatctccgagatgggggccaacttccgcgccggccgggtgatcgacccccgccggtgcctgaagcccgtgatcctcaccgacgggccggagcgcgtcatcctggccggccccatccccgtgacccccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacgcccgaggggatcatccccaccctgttcggcccggagcgggagaagacccaggccatcgacggcgagttccgcctccggggggagcagcgcaagaccttcgtcgagctgatgcggcgcggcgacctgcccgtgtggctcagctacaaggtggcctccgccgggatcagctacaaggaccgggagtggtgcttcacgggcgagcgcaacaaccagatcctggaggagaacatggaggtcgagatctggacccgggagggggagaagaagaagctgcgcccccggtggctcgacgcccgcgtgtacgcggaccccatggccctgaaggacttcaaggagttcgcctccggccgcaagagcatcaccctggacatcctcaccgagatcgcctccctgccgacctacctgagcagccgggccaagctcgcgctggacaacatcgtgatgctgcacacgaccgagcgcggcgggcgggcctaccagcacgccctcaacgagctgcccgagtccctggagaccctcatgctggtcgccctgctcggcgcgatgaccgccgggatcttcctgttcttcatgcagggcaaggggatcggcaagctgagcatgggcctcatcacgatcgccgtggcctccgggctgctgtgggtggccgagatccagccccagtggatcgcggccagcatcatcctcgagttcttcctgatggtcctgctcatcccggagcccgagaagcagcgcaccccccaggacaaccagctgatctacgtgatcctgaccatcctcaccatcatcggcctgatcgccgccaacgagatggggctgatcgagaagacgaagaccgacttcggcttctaccaggtgaagaccgagaccacgatcctcgacgtcgacctgcggcccgcctccgcgtggaccctgtacgccgtggccaccaccatcctcacgccgatgctgcgccacaccatcgagaacaccagcgccaacctgtccctcgccgcgatcgccaaccaggccgccgtgctgatggggctgggcaagggctggcccctccaccggatggacctgggggtccccctgctcgccatgggctgctacagccaggtgaaccccaccacgctgaccgcgtccctggtgatgctcctggtccactacgccatcatcgggccgggcctgcaggccaaggccacccgcgaggcgcagaagcggaccgccgccggcatcatgaagaaccccacggtggacgggatcaccgtgatcgacctcgagcccatcagctacgaccccaagttcgagaagcagctgggccaggtcatgctgctcgtgctgtgcgccgggcagctgctcctgatgcgcaccacctgggccttctgcgaggtgctgacgctcgcgaccggcccgatcctgaccctgtgggaggggaaccccggccggttctggaacaccacgatcgccgtctccaccgccaacatcttccgcggcagctacctcgccggggccggcctggcgttctccctgatcaagaacgcccagaccccccggcgcgggaccggcacgaccggggagaccctcggcgagaagtggaagcggcagctgaacagcctggaccgcaaggagttcgaggagtacaagcggtccggcatcctcgaggtggaccgcaccgaggccaagagcgccctgaaggacgggtccaagatcaagcacgccgtgagccggggctccagcaagatccgctggatcgtcgagcgcgggatggtgaagcccaagggcaaggtggtcgacctggggtgcggccggggcgggtggagctactacatggcgaccctcaagaacgtgacggaggtgaagggctacaccaaggggggcccggggcacgaggagcccatccccatggccacctacggctggaacctggtcaagctgcactccggcgtggacgtgttctacaagcccaccgagcaggtcgacacgctcctgtgcgacatcggggagagctccagcaacccgaccatcgaggagggccgcaccctgcgggtgctcaagatggtggagccctggctgtccagcaagcccgagttctgcatcaaggtcctgaacccctacatgccgaccgtgatcgaggagctggagaagctccagcgcaagcacgggggcaacctggtccggtgccccctgtcccgcaacagcacgcacgagatgtactgggtgtccggcgccagcgggaacatcgtgtccagcgtcaacaccacctccaagatgctcctgaaccggttcaccacgcgccaccggaagcccacctacgagaaggacgtggacctgggcgccgggacccgcagcgtgtccaccgagacggagaagcccgacatgaccatcatcggccggcgcctccagcggctgcaggaggagcacaaggagacctggcactacgaccaggagaacccgtaccgcacctgggcgtaccacgggagctacgaggccccctccacgggcagcgcctccagcatggtcaacggcgtggtgaagctgctcaccaagccctgggacgtcatcccgatggtgacccagctggccatgaccgacacgacccccttcgggcagcagcgggtgttcaaggagaaggtcgacacccgcaccccccagcccaagccgggcacgcggatggtgatgaccaccaccgccaactggctgtgggcgctcctggggaagaagaagaacccccgcctgtgcacgcgggaggagttcatcagcaaggtgcgctccaacgccgccatcggcgccgtcttccaggaggagcaggggtggaccagcgcctccgaggcggtgaacgacagccggttctgggagctcgtggacaaggagcgcgccctgcaccaggagggcaagtgcgagtcctgcgtctacaacatgatgggcaagcgcgagaagaagctgggggagttcggccgggccaaggggagccgcgccatctggtacatgtggctcggcgcccggttcctggagttcgaggcgctggggttcctcaacgaggaccactggttcggccgcgagaactcctggagcggcgtggagggggagggcctgcaccggctggggtacatcctcgaggagatcgacaagaaggacggcgacctgatgtacgccgacgacaccgccggctgggacacccgcatcacggaggacgacctgcagaacgaggagctcatcaccgagcagatggccccccaccacaagatcctggcgaaggccatcttcaagctgacctaccagaacaaggtggtcaaggtgctccggcccaccccgcgcggggccgtgatggacatcatctcccggaaggaccagcgcggcagcgggcaggtcggcacctacgggctgaacacgttcaccaacatggaggtgcagctgatccggcagatggaggccgagggcgtgatcacccaggacgacatgcagaaccccaagggcctcaaggagcgcgtcgagaagtggctgcgggagtgcggggtggaccgcctgaagcggatggccatctccggcgacgactgcgtggtcaagcccctcgacgagcgcttcgggaccagcctgctgttcctcaacgacatgggcaaggtgcggaaggacatcccccagtgggagccgtccaaggggtggaagaactggcaggaggtgcccttctgcagccaccacttccacaagatcttcatgaaggacggccgctccctggtcgtgccctgccggaaccaggacgagctgatcggccgcgcgcgcatcagccagggggccggctggtccctccgggagacggcctgcctggggaaggcctacgcccagatgtggagcctgatgtacttccaccgccgggacctccgcctggcgagcatggccatctgctccgccgtgcccaccgagtggttcccgaccagccggaccacgtggtccatccacgcccaccaccagtggatgaccaccgaggacatgctgaaggtctggaaccgcgtgtggatcgaggacaaccccaacatgatcgacaagacccccgtgcacagctgggaggacatcccctacctcggcaagcgggaggacctgtggtgcgggtccctgatcggcctcagctcccgcgccacgtgggcgaagaacatccacaccgccatcacccaggtccggaacctgatcggcaaggaggagtacgtggactacatgccggtgatgaagcgctacagcgccccctccgagagcgagggggtcctgtga

SEQ ID NO: 10450 - RNA, 9867 nt, synthetic construct
  misc_feature 1..9867: note = derived and/or modified CDS sequence (opt1) from DENV-4__FJ850059__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgtgtgggtggacctcgtcctggagcacggcgggtgcgtgaccaccatggcgcagggcaagcccaccctggacttcgagctcacgaagaccaccgccaaggaggtggccctgctgcggacctactgcatcgaggcctccatcagcaacatcacgaccgccacccgctgcccgacccagggggagccctacctcaaggaggagcaggaccagcagtacatctgccggcgcgacgtcgtggaccggggctgggggaacggctgcggcctgttcgggaagggcggggtggtcacgtgcgcgaagttctcctgcagcggcaagatcaccgggaacctggtgcagatcgagaacctcgagtacaccgtggtcgtgaccgtccacaacggcgacacgcacgccgtgggcaacgacacctccaaccacggggtgaccgccaccatcacgccccgcagcccctccgtcgaggtgaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgccgacacctccgaggtccactggaactacaaggagcgcatggtgacgttcaaggtgccgcacgcgaagcggcaggacgtcaccgtgctcgggagccaggagggcgccatgcacagcgccctggccggcgccaccgaggtggactccggggacggcaaccacatgttcgcggggcacctgaagtgcaaggtccgcatggagaagctccgcatcaagggcatgagctacaccatgtgctccggcaagttcagcatcgacaaggagatggccgagacgcagcacgggaccaccgtggtgaaggtcaagtacgagggcgccggggccccctgcaaggtgcccatcgagatccgggacgtgaacaaggagaaggtcgtgggccgcgtgatctccagcacccccctggccgagaacacgaactccgtcaccaacatcgagctggagccgcccttcggggacagctacatcgtgatcggcgtgggcaactccgcgctcaccctgcactggttccggaaggggagctccatcggcaagatgttcgagagcacctaccgcggggccaagcggatggccatcctgggcgagacggcctgggacttcgggtccgtcggcggcctcttcaccagcctggggaaggcggtgcaccaggtgttcggctccgtctacaccaccatgttcgggggcgtgagctggatgatccgcatcctgatcgggttcctcgtgctgtggatcggcacgaactcccggaacaccagcatggccatgacctgcatcgccgtcggcgggatcaccctgttcctgggcttcacggtgcaggccgacatggggtgcgtggtctcctggagcggccgcgagctcaagtgcgggagcggcatcttcgtggtggacaacgtccacacctggaccgagcagtacaagttccagcccgagtcccccgcccggctggcgagcgccatcctgatcgcccacaaggacggcgtgtgcgggatccgctccaccacgcggctcgagaacgtgatgtggaagcagatcaccaacgagctgaactacgtcctgtgggagggcgggcacgacctcaccgtggtggccggcgacgccaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctctccgagaaggaggagaacatggtgaagagccaggtcacggccggccagggcacctccgagaccttcagcatggggctgctgtgcctcaccctgttcgtggaggagtgcctgcggcgccgggtgacgcgcaagcacatgatcctcgccgtcgtgatcaccctgtgcgcgatcatcctgggcgggctcacctggatggacctgctgcgggccctcatcatgctgggcgacaccatgtccggccgcatcgggggccagacgcacctggccatcatggccgtgttcaagatgagccccgggtacgtcctcggcgtgttcctgcggaagctgacctcccgcgagaccgccctcatggtgatcgggatggcgatgaccacgaccctgagcatcccgcacgacctgatggagctcatcgacggcatctccctgggcctgatcctcctgaagatcgtcacccagttcgacaacacccaggtggggacgctggccctcagcctgaccttcatccggtccaccatgagcctggtgatggcctggcgcaccatcatggccgtcctcttcgtggtgacgctgatccccctgtgccggacctcctgcctccagaagcagagccactgggtcgagatcaccgccctgatcctgggcgcgcaggccctccccgtgtacctgatgaccctgatgaagggggcctcccgccggagctggcccctcaacgagggcatcatggccgtggggctggtctccctgctcggcagcgcgctgctgaagaacgacgtgccgctcgccggccccatggtggccgggggcctgctgctcgccgcctacgtcatgagcgggtccagcgcggacctgtccctggagaaggccgccaacgtgcagtgggacgagatggccgacatcacgggcagctcccccatcatcgaggtgaagcaggacgaggacgggagcttctccatccgcgacgtcgaggagaccaacatgatcaccctcctggtgaagctggccctcatcaccgtgagcggcctgtaccccctggcgatcccggtcacgatgaccctctggtacatgtggcaggtgaagacccagcggtccggcgccctgtgggacgtgcccagccccgccgccacccagaaggccgcgctgtccgagggggtctaccgcatcatgcagcggggcctcttcgggaagacccaggtgggcgtggggatccacatggagggcgtcttccacacgatgtggcacgtgacccgcggcagcgtgatctgccacgagaccgggcggctggagccctcctgggccgacgtccgcaacgacatgatcagctacggcgggggctggcgcctgggcgacaagtgggacaaggaggaggacgtgcaggtgctcgccatcgagccggggaagaaccccaagcacgtccagaccaagcccggcctgttcaagacgctgaccggggagatcggcgccgtgaccctcgacttcaagcccgggacctccggcagcccgatcatcaaccggaagggcaaggtgatcgggctgtacggcaacggggtcgtgacgaagtccggcgactacgtgagcgccatcacccaggcggagcgcatcggggagcccgactacgaggtcgacgaggacatcttccggaagaagcgcctgaccatcatggacctccaccccggcgccggcaagaccaagcggatcctgccgtccatcgtgcgcgaggccctgaagcggcgcctgcggacgctcatcctggcccccacccgcgtggtcgcggccgagatggaggaggccctgcgggggctccccatccgctaccagacccccgccgtgaagagcgagcacaccggccgggagatcgtggacctgatgtgccacgccacgttcaccacccgcctgctcagctccacccgggtcccgaactacaacctgatcgtgatggacgaggcgcacttcacggaccccagctccgtcgccgcccgcgggtacatcagcacccgggtggagatgggcgaggccgccgcgatcttcatgaccgccaccccccccggggccacggacccgttcccccagtccaacagccccatcgaggacatcgagcgcgagatccccgagcggtcctggaacaccggcttcgactggatcaccgactaccagggcaagaccgtgtggttcgtcccgagcatcaaggccgggaacgacatcgccaactgcctgcgcaagtccggcaagaaggtgatccagctcagccgcaagacgttcgacaccgagtaccccaagaccaagctgaccgactgggacttcgtggtcacgaccgacatctccgagatgggggcgaacttccgggccggccgcgtgatcgacccccggcgctgcctgaagcccgtgatcctcaccgacgggccggagcgggtcatcctggccggccccatccccgtgacccccgccagcgcggcccagcgccggggccgcatcgggcggaacccggcccaggaggacgaccagtacgtgttctccggcgaccccctgaagaacgacgaggaccacgcccactggacggaggccaagatgctcctggacaacatctacacccccgaggggatcatccccaccctgttcggcccggagcgcgagaagacccaggcgatcgacggcgagttccggctccgcggggagcagcggaagacgttcgtcgagctgatgcgccggggcgacctgcccgtgtggctcagctacaaggtggcctccgccgggatcagctacaaggaccgcgagtggtgcttcaccggcgagcggaacaaccagatcctggaggagaacatggaggtcgagatctggacccgcgagggggagaagaagaagctgcggccccgctggctcgacgcccgggtgtacgccgaccccatggcgctgaaggacttcaaggagttcgcctccggccgcaagagcatcaccctggacatcctcaccgagatcgcctccctgccgacgtacctgagcagccgcgccaagctcgccctggacaacatcgtgatgctgcacaccaccgagcggggcgggcgcgcgtaccagcacgccctcaacgagctgcccgagtccctggagaccctcatgctggtcgccctgctcggcgccatgacggcggggatcttcctgttcttcatgcagggcaaggggatcggcaagctgagcatgggcctcatcaccatcgccgtggcctccgggctgctgtgggtggccgagatccagccccagtggatcgccgcgagcatcatcctcgagttcttcctgatggtcctgctcatcccggagcccgagaagcagcggaccccccaggacaaccagctgatctacgtgatcctgaccatcctcacgatcatcggcctgatcgccgccaacgagatggggctgatcgagaagaccaagaccgacttcggcttctaccaggtgaagaccgagacgaccatcctcgacgtcgacctgcgccccgcctccgcctggaccctgtacgcggtggccaccacgatcctcaccccgatgctgcggcacaccatcgagaacaccagcgccaacctgtccctcgccgccatcgcgaaccaggccgccgtgctgatggggctgggcaagggctggcccctccaccgcatggacctgggggtccccctgctcgccatgggctgctacagccaggtgaaccccacgaccctgaccgcctccctggtgatgctcctggtccactacgcgatcatcgggccgggcctgcaggccaaggccacccgggaggcccagaagcgcacggcggccggcatcatgaagaaccccaccgtggacgggatcaccgtgatcgacctcgagcccatcagctacgaccccaagttcgagaagcagctgggccaggtcatgctgctcgtgctgtgcgccgggcagctgctcctgatgcggaccacgtgggccttctgcgaggtgctgaccctcgccaccggcccgatcctgaccctgtgggaggggaaccccggccgcttctggaacacgaccatcgcggtctccaccgccaacatcttccggggcagctacctcgccggggccggcctggccttctccctgatcaagaacgcgcagaccccccgccgggggacgggcaccaccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgccgtgagccgcggctccagcaagatccggtggatcgtcgagcgcgggatggtgaagcccaagggcaaggtggtcgacctggggtgcggccgcggcgggtggagctactacatggccacgctcaagaacgtgaccgaggtgaagggctacaccaaggggggcccggggcacgaggagcccatccccatggcgacctacggctggaacctggtcaagctgcactccggcgtggacgtgttctaccggcccacggagcaggtcgacaccctcctgtgcgacatcggggagagctccagcaacccgaccatcgaggagggccgcaccctgcgggtgctcaagatggtggagccctggctgtccagcaagcccgagttctgcatcaaggtcctgaacccctacatgccgacggtgatcgaggagctggagaagctccagcgcaagcacgggggcaacctggtccggtgccccctgtcccgcaacagcacccacgagatgtactgggtgtccggcgccagcgggaacatcgtgtccagcgtcaacaccacctccaagatgctcctgaaccggttcacgacccgccaccggaagcccacctacgagaaggacgtggacctgggcgccgggacccgcagcgtgtccacggagaccgagaagcccgacatgaccatcatcggccggcgcctccagcggctgcaggaggagcacaaggagacctggcactacgaccaggagaacccgtaccgcacgtgggcctaccacgggagctacgaggcgccctccaccggcagcgcctccagcatggtcaacggcgtggtgaagctgctcaccaagccctgggacgtcatcccgatggtgacccagctggccatgacggacaccacccccttcgggcagcagcgggtgttcaaggagaaggtcgacacccgcacgccccagcccaagccgggcacccggatggtgatgaccaccacggccaactggctgtgggccctcctggggaagaagaagaacccccgcctgtgcacccgggaggagttcatcagcaaggtgcgctccaacgcggccatcggcgccgtcttccaggaggagcaggggtggaccagcgcctccgaggccgtgaacgacagccggttctgggagctcgtggacaaggagcgcgcgctgcaccaggagggcaagtgcgagtcctgcgtctacaacatgatgggcaagcgcgagaagaagctgggggagttcggccgggccaaggggagccgcgccatctggtacatgtggctcggcgcccggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgcggacgacaccgccggctgggacacgcgcatcaccgaggacgacctgcagaacgaggagctcatcaccgagcagatggccccccaccacaagatcctggccaaggcgatcttcaagctgacctaccagaacaaggtggtcaaggtgctccggcccaccccgcgcggggccgtgatggacatcatctcccggaaggaccagcgcggcagcgggcaggtcggcacgtacgggctgaacaccttcaccaacatggaggtgcagctgatccggcagatggaggccgagggcgtgatcacccaggacgacatgcagaaccccaagggcctcaaggagcgcgtcgagaagtggctgcgggagtgcggggtggaccgcctgaagcggatggccatctccggcgacgactgcgtggtcaagcccctcgacgagcgcttcgggacgagcctgctgttcctcaacgacatgggcaaggtgcggaaggacatcccccagtgggagccgtccaaggggtggaagaactggcaggaggtgcccttctgcagccaccacttccacaagatcttcatgaaggacggccgctccctggtcgtgccctgccggaaccaggacgagctgatcggccgcgcccgcatcagccagggggcgggctggtccctccgggagaccgcctgcctggggaaggcctacgcccagatgtggagcctgatgtacttccaccgccgggacctccgcctggccagcatggcgatctgctccgccgtgcccaccgagtggttcccgaccagccggacgacctggtccatccacgcccaccaccagtggatgaccaccgaggacatgctgaaggtctggaaccgcgtgtggatcgaggacaaccccaacatgatcgacaagacgcccgtgcacagctgggaggacatcccctacctcggcaagcgggaggacctgtggtgcgggtccctgatcggcctcagctcccgcgccacctgggccaagaacatccacaccgcgatcacccaggtccggaacctgatcggcaaggaggagtacgtggactacatgccggtgatgaagcgctacagcgccccctccgagagcgagggggtcctgtga

SEQ ID NO: 10451 - RNA, 9867 nt, synthetic construct
  misc_feature 1..9867: note = derived and/or modified CDS sequence (opt1) from DENV-4__FJ882598__SS-prME
  source 1..9867: mol_type = other RNA
agcaccatcaccctgctctgcctgatccccacggccatggccttccacctgtccacccgcgacggcgagccgctcatgatcgtggcgaagcacgagcgggggcgccccctgctgttcaagaccaccgagggcatcaacaagtgcacgctcatcgccatggacctgggggagatgtgcgaggacaccgtcacctacaagtgccccctgctcgtgaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgtccatcagcaacatcacgaccgccacccgctgcccgacccagggggagccctacctcaaggaggagcaggaccagcagtacatctgccggcgcgacgtggtggaccggggctgggggaacggctgcggcctgttcgggaagggcggggtcgtgacgtgcgccaagttctcctgcagcggcaagatcaccgggaacctggtgcagatcgagaacctcgagtacaccgtcgtggtgaccgtccacaacggcgacacgcacgccgtgggcaacgacacctccaaccacggggtcaccgccaccatcacgccccgcagcccctccgtggaggtgaagctgccggactacggcgagctgaccctcgactgcgagccccggagcgggatcgacttcaacgagatgatcctgatgaagatgaagaagaagacctggctggtccacaagcagtggttcctcgacctgcccctgccctggaccgcgggcgccgacacctccgaggtgcactggaactacaaggagcgcatggtgacgttcaaggtcccgcacgccaagcggcaggacgtgaccgtgctcgggagccaggagggcgccatgcacagcgccctggcgggcgccaccgaggtcgactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatctccagcacccccctggccgagaacacgaactccgtgaccaacatcgagctggagccgcccttcggggacagctacatcgtgatcggcgtcggcaactccgccctcaccctgcactggttccggaaggggagctccatcggcaagatgttcgagagcacctaccgcggggccaagcggatggcgatcctgggcgagacggcctgggacttcgggtccgtgggcggcctcttcaccagcctggggaaggccgtgcaccaggtcttcggctccgtgtacaccaccatgttcgggggcgtgagctggatgatccgcatcctgatcgggttcctcgtcctgtggatcggcacgaactcccggaacaccagcatggccatgacctgcatcgccgtgggcgggatcaccctgttcctgggcttcacggtgcaggcggacatggggtgcgtcgtgtcctggagcggccgcgagctcaagtgcgggagcggcatcttcgtggtcgacaacgtgcacacctggaccgagcagtacaagttccagcccgagtcccccgcccggctggccagcgccatcctgaacgcccacaaggacggcgtgtgcgggatccgctccaccacgcggctcgagaacgtcatgtggaagcagatcaccaacgagctgaactacgtgctgtgggagggcgggcacgacctcaccgtggtcgcgggcgacgtgaagggcgtgctgaccaaggggaagcgcgccctgacgccgcccgtcagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacctggcagatcgagaaggcgagcctgatcgaggtgaagacgtgcctgtggcccaagacccacaccctctggtccaacggggtgctggagagccagatgctgatccccaagtcctacgccggcccgttcagccagcacaactaccgccaggggtacgccacccagaccgtcggcccctggcacctcgggaagctggagatcgacttcggcgagtgccccggcacgaccgtgaccatccaggaggactgcgaccaccgggggcccagcctgcgcaccacgaccgcctccggcaagctcgtgacccagtggtgctgccgcagctgcaccatgccgcccctgcggttcctgggggaggacggctgctggtacgggatggagatccgccccctctccgagaaggaggagaacatggtcaagagccaggtggccgcgggccagggcacgtccgagaccttcagcatggggctgctgtgcctcaccctgttcgtcgaggagtgcctgcggcgccgggtgacccgcaagcacatgatcctcgccgtggtcatcacgctgtgcgccatcatcctgggcgggctcacctggatggacctgctgcgggccctcatcatgctgggcgacaccatgtccggccgcatcgggggccagacccacctggccatcatggcggtgttcaagatgagccccgggtacgtgctcggcgtcttcctgcggaagctgacgtcccgcgagaccgccctcatggtgatcgggatggccatgaccaccacgctgagcatcccgcacgacctgatggagctcatcgacggcatctccctgggcctgatcctcctgaagatcgtgacccagttcgacaacacccaggtcgggaccctggccctcagcctgacgttcatccggtccaccatgagcctggtgatggcctggcgcaccatcatggcggtgctcttcgtcgtgaccctgatccccctgtgccggacgtcctgcctccagaagcagagccactgggtggagatcaccgccctgatcctgggcgcccaggccctccccgtctacctgatgaccctgatgaagggggcgtcccgccggagctggcccctcaacgagggcatcatggccgtggggctggtgtccctgctcggcagcgccctgctgaagaacgacgtcccgctcgccggccccatggtggccgggggcctgctgctcgcggcctacgtgatgagcgggtccagcgccgacctgtccctggagaaggccgccaacgtccagtgggacgagatggcggacatcaccggcagctcccccatcatcgaggtgaagcaggacgaggacgggagcttctccatccgcgacgtggaggagacgaacatgatcaccctcctggtcaagctggccctcatcaccgtgagcggcctgtaccccctggccatcccggtgaccatgacgctctggtacatgtggcaggtcaagacccagcggtccggcgccctgtgggacgtgcccagccccgccgcgacccagaaggccgccctgtccgagggggtgtaccgcatcatgcagcggggcctcttcgggaagacccaggtcggcgtggggatccacatggagggcgtgttccacaccatgtggcacgtcacgcgcggcagcgtgatctgccacgagaccgggcggctggagccctcctgggccgacgtgcgcaacgacatgatcagctacggcgggggctggcgcctgggcgacaagtgggacaaggaggaggacgtccaggtgctcgccatcgagccggggaagaaccccaagcacgtgcagaccaagcccggcctgttcaagaccctgacgggggagatcggcgcggtcaccctcgacttcaagcccgggacctccggcagcccgatcatcaaccggaagggcaaggtgatcgggctgtacggcaacggggtggtcaccaagtccggcgactacgtgagcgccatcacgcaggccgagcgcatcggggagcccgactacgaggtggacgaggacatcttccggaagaagcgcctgaccatcatggacctccaccccggcgccggcaagaccaagcggatcctgccgtccatcgtccgcgaggcgctgaagcggcgcctgcggaccctcatcctggcccccacgcgcgtggtggccgccgagatggaggaggccctgcgggggctccccatccgctaccagacccccgcggtcaagagcgagcacaccggccgggagatcgtggacctgatgtgccacgccaccttcacgacccgcctgctcagctccacccgggtgccgaactacaacctgatcgtcatggacgaggcccacttcaccgaccccagctccgtggccgcccgcgggtacatcagcacgcgggtcgagatgggcgaggcggccgccatcttcatgaccgccaccccccccggggccaccgacccgttcccccagtccaacagccccatcgaggacatcgagcgcgagatccccgagcggtcctggaacacgggcttcgactggatcaccgactaccagggcaagaccgtgtggttcgtgccgagcatcaaggcggggaacgacatcgccaactgcctgcgcaagtccggcaagaaggtcatccagctcagccgcaagaccttcgacacggagtaccccaagaccaagctgaccgactgggacttcgtggtgaccacggacatctccgagatgggggccaacttccgggccggccgcgtcatcgacccccggcgctgcctgaagcccgtgatcctcaccgacgggccggagcgggtgatcctggcgggccccatccccgtcacccccgccagcgccgcccagcgccggggccgcatcgggcggaacccggcccaggaggacgaccagtacgtgttctccggcgaccccctgaagaacgacgaggaccacgcgcactggaccgaggccaagatgctcctggacaacatctacacgcccgaggggatcatccccaccctgttcggcccggagcgcgagaagacccaggccatcgacggcgagttccggctccgcggggagcagcggaagaccttcgtggagctgatgcgccggggcgacctgcccgtctggctcagctacaaggtggcctccgccgggatcagctacaaggaccgcgagtggtgcttcacgggcgagcggaacaaccagatcctggaggagaacatggaggtggagatctggacccgcgagggggagaagaagaagctgcggccccgctggctcgacgcgcgggtctacgccgaccccatggccctgaaggacttcaaggagttcgcctccggccgcaagagcatcaccctggacatcctcaccgagatcgcctccctgccgacctacctgagcagccgcgcgaagctcgccctggacaacatcgtgatgctgcacacgaccgagcggggcgggcgcgcctaccagcacgccctcaacgagctgcccgagtccctggagaccctcatgctggtggcgctgctcggcgccatgaccgccgggatcttcctgttcttcatgcagggcaaggggatcggcaagctgagcatgggcctcatcacgatcgccgtcgcctccgggctgctgtgggtggcggagatccagccccagtggatcgccgccagcatcatcctcgagttcttcctgatggtgctgctcatcccggagcccgagaagcagcggaccccccaggacaaccagctgatctacgtcatcctgaccatcctcaccatcatcggcctgatcgccgccaacgagatggggctgatcgagaagacgaagaccgacttcggcttctaccaggtgaagaccgagaccacgatcctcgacgtggacctgcgccccgcgtccgcctggaccctgtacgccgtcgccaccaccatcctcacgccgatgctgcggcacaccatcgagaacaccagcgccaacctgtccctcgcggccatcgccaaccaggccgccgtgctgatggggctgggcaagggctggcccctccaccgcatggacctgggggtgcccctgctcgcgatgggctgctacagccaggtcaaccccaccacgctgaccgcctccctggtgatgctcctggtgcactacgccatcatcgggccgggcctgcaggccaaggcgacccgggaggcccagaagcgcaccgccgccggcatcatgaagaaccccacggtcgacgggatcaccgtgatcgacctcgagcccatcagctacgaccccaagttcgagaagcagctgggccaggtgatgctgctcgtcctgtgcgccgggcagctgctcctgatgcggaccacctgggcgttctgcgaggtgctgacgctcgccaccggcccgatcctgaccctgtgggaggggaaccccggccgcttctggaacaccacgatcgccgtgtccaccgccaacatcttccggggcagctacctcgccggggcgggcctggccttctccctgatcaagaacgcccagaccccccgccgggggaccggcacgaccggggagaccctcggcgagaagtggaagcgccagctgaacagcctggaccggaaggagttcgaggagtacaagcgctccggcatcctcgaggtcgaccggaccgaggccaagagcgccctgaaggacgggtccaagatcaagcacgcggtgagccgcggctccagcaagatccggtggatcgtggagcgcgggatggtcaagcccaagggcaaggtggtggacctggggtgcggccgcggcgggtggagctactacatggccaccctcaagaacgtcacggaggtgaagggctacaccaaggggggcccggggcacgaggagcccatccccatggccacctacggctggaacctggtgaagctgcactccggcgtcgacgtgttctacaagcccaccgagcaggtggacacgctcctgtgcgacatcggggagagctccagcaacccgaccatcgaggagggccggaccctgcgcgtcctcaagatggtggagccctggctgtccagcaagcccgagttctgcatcaaggtgctgaacccctacatgccgaccgtcatcgaggagctggagaagctccagcggaagcacgggggcaacctggtgcgctgccccctgtcccggaacagcacgcacgagatgtactgggtctccggcgccagcgggaacatcgtgtccagcgtgaacaccacctccaagatgctcctgaaccgcttcaccacgcggcaccgcaagcccacctacgagaaggacgtcgacctgggcgcggggacccggagcgtgtccaccgagacggagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtgaacggcgtcgtgaagctgctcaccaagccctgggacgtgatcccgatggtcacccagctggccatgaccgacacgacccccttcgggcagcagcgcgtgttcaaggagaaggtggacacccggaccccccagcccaagccgggcacgcgcatggtcatgaccaccaccgcgaactggctgtgggccctcctggggaagaagaagaacccccggctgtgcacgcgcgaggagttcatcagcaaggtgcggtccaacgccgccatcggcgccgtgttccaggaggagcaggggtggaccagcgcgtccgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggcgccccaccacaagatcctggccaaggccatcttcaagctgacctaccagaacaaggtggtgaaggtcctccgccccaccccgcggggggccgtgatggacatcatctcccgcaaggaccagcggggcagcgggcaggtgggcacctacgggctgaacacgttcaccaacatggaggtccagctgatccgccagatggaggccgagggcgtgatcacccaggacgacatgcagaaccccaagggcctcaaggagcgggtggagaagtggctgcgcgagtgcggggtcgaccggctgaagcgcatggcgatctccggcgacgactgcgtggtgaagcccctcgacgagcggttcgggaccagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggccggctggtccctccgcgagacggcctgcctggggaaggcctacgcgcagatgtggagcctgatgtacttccaccggcgcgacctccggctggccagcatggccatctgctccgccgtgcccaccgagtggttcccgaccagccgcaccacgtggtccatccacgcccaccaccagtggatgaccaccgaggacatgctgaaggtgtggaaccgggtctggatcgaggacaaccccaacatgatcgacaagacccccgtgcacagctgggaggacatcccctacctcggcaagcgcgaggacctgtggtgcgggtccctgatcggcctcagctcccgggcgacgtgggccaagaacatccacaccgccatcacccaggtgcgcaacctgatcggcaaggaggagtacgtcgactacatgccggtgatgaagcggtacagcgccccctccgagagcgagggggtgctgtga

SEQ ID NO: 10452 - RNA, 9867 nt, synthetic construct
  misc_feature 1..9867: note = derived and/or modified CDS sequence (opt1) from DENV-4__FJ882601__SS-prME
  source 1..9867: mol_type = other RNA
agcaccatcaccctgctctgcctgatccccaccgtgatggccttccacctgtccacccgcgacggcgagcccctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcaccgtgttcttcgtgctgatgatgctggtggccccctcctacggcatgcggtgcgtgggcgtggggaaccgcgacttcgtggagggcgtgagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacgcccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctctccgagaaggaggagaacatggtcaagagccaggtcgccgccggccagggcacgtccgagaccttcagcatggggctgctgtgcctcaccctgttcgtggaggagtgcctgcggcgccgggtgacccgcaagcacatgatcctcgcggtcgtgatcacgctgtgcgccatcatcctgggcgggctcacctggatggacctgctgcgggccctcatcatgctgggcgacaccatgtccggccgcatcgggggccagacccacctggccatcatggccgtgttcaagatgagccccgggtacgtcctcggcgtgttcctgcggaagctgacgtcccgcgagaccgcgctcatggtgatcgggatggccatgaccaccacgctgagcatcccgcacgacctgatggagctcatcgacggcatctccctgggcctgatcctcctgaagatcgtcacccagttcgacaacacccaggtggggaccctggccctcagcctgacgttcatccggtccaccatgagcctggtgatggcctggcgcaccatcatggccgtcctcttcgtggtgaccctgatccccctgtgccggacgtcctgcctccagaagcagagccactgggtcgagatcaccgcgctgatcctgggcgcccaggccctccccgtgtacctgatgaccctgatgaagggggcctcccgccggagctggcccctcaacgagggcatcatggcggtggggctggtctccctgctcggcagcgccctgctgaagaacgacgtgccgctcgccggccccatggtggccgggggcctgctgctcgccgcgtacgtcatgagcgggtccagcgccgacctgtccctggagaaggccgccaacgtgcagtgggacgagatggccgacatcaccggcagctcccccatcatcgaggtgaagcaggacgaggacgggagcttctccatccgcgacgtcgaggagacgaacatgatcaccctcctggtgaagctggcgctcatcaccgtgagcggcctgtaccccctggccatcccggtcaccatgacgctctggtacatgtggcaggtcaagacccagcggtccggcgccctgtgggacgtgcccagccccgccgccacccagaaggcggccctgtccgagggggtctaccgcatcatgcagcggggcctcttcgggaagacccaggtgggcgtggggatccacatggagggcgtcttccacaccatgtggcacgtgacgcgcggcagcgtgatctgccacgagaccgggcggctggagccctcctgggccgacgtccgcaacgacatgatcagctacggcgggggctggcgcctgggcgacaagtgggacaaggaggaggacgtccaggtgctcgccatcgagccggggaagaaccccaagcacgtccagaccaagcccggcctgttcaagaccctgacgggggagatcggcgccgtgaccctcgacttcaagcccgggacctccggcagcccgatcgtgaaccggaagggcaaggtcatcgggctgtacggcaacggggtggtgaccaagtccggcgactacgtcagcgcgatcacgcaggccgagcgcatcggggagcccgactacgaggtggacgaggacatcttccggaagaagcgcctgaccatcatggacctccaccccggcgccggcaagaccaagcggatcctgccgtccatcgtgcgcgaggccctgaagcggcgcctgcggaccctcatcctggcgcccacgcgcgtcgtggccgccgagatggaggaggccctgcgggggctccccatccgctaccagacccccgccgtcaagagcgagcacaccggccgggagatcgtcgacctgatgtgccacgcgaccttcacgacccgcctgctcagctccacccgggtgccgaactacaacctgatcgtcatggacgaggcccacttcaccgaccccagctccgtggccgcccgcgggtacatcagcacgcgggtggagatgggcgaggccgcggccatcttcatgaccgccacgccgcccggggccaccgacccgttcccccagtccaacagccccatcgaggacatcgagcgcgagatccccgagcggtcctggaacacgggcttcgactggatcaccgactaccagggcaagaccgtctggttcgtgccgagcatcaaggccgggaacgacatcgcgaactgcctgcgcaagtccggcaagaaggtgatccagctcagccgcaagaccttcgacacggagtaccccaagaccaagctgaccgactgggacttcgtcgtgaccacggacatctccgagatgggggccaacttccgggccggccgcgtgatcgacccccggcgctgcctgaagcccgtcatcctcaccgacgggccggagcgggtgatcctggccggccccatccccgtgacccccgcgagcgccgcccagcgccggggccgcatcgggcggaacccggcccaggaggacgaccagtacgtcttctccggcgaccccctgaagaacgacgaggaccacgcccactggaccgaggcgaagatgctcctggacaacatctacacgcccgaggggatcatccccaccctgttcggcccggagcgcgagaagacccaggccatcgacggcgagttccggctccgcggggagcagcggaagaccttcgtggagctgatgcgccggggcgacctgcccgtgtggctcagctacaaggtcgcctccgccgggatcagctacaaggaccgcgagtggtgcttcacgggcgagcggaacaaccagatcctggaggagaacatggaggtggagatctggacccgcgagggggagaagaagaagctgcggccccgctggctcgacgcccgggtgtacgcggaccccatggccctgaaggacttcaaggagttcgcctccggccgcaagagcatcaccctggacatcctcaccgagatcgcctccctgccgacctacctgagcagccgcgccaagctcgcgctggacaacatcgtcatgctgcacacgaccgagcggggcgggcgcgcctaccagcacgccctcaacgagctgcccgagtccctggagaccctcatgctggtggccctgctcggcgcgatgaccgccgggatcttcctgttcttcatgcagggcaaggggatcggcaagctgagcatgggcctcatcacgatcgccgtggcctccgggctgctgtgggtcgccgagatccagccccagtggatcgcggccagcatcatcctcgagttcttcctgatggtgctgctcatcccggagcccgagaagcagcggacgccccaggacaaccagctgatctacgtgatcctggccatcctcaccatcatcggcctgatcgccgccaacgagatggggctgatcgagaagaccaagacggacttcggcttctaccaggagaagaccgagaccaccatcctcgacgtcgacctgcgccccgcgtccgcctggacgctgtacgccgtggccaccaccatcctcaccccgatgctgcggcacacgatcgagaacaccagcgccaacctgtccctcaccgcgatcgccaaccaggccgccgtgctgatggggctgggcaagggctggcccctccaccgcatggacctgggggtccccctgctcgccatgggctgctacagccaggtgaaccccaccacgctgaccgcgtccctggtgatgctcctggtccactacgccatcatcgggccgggcctgcaggccaaggccacccgggaggcgctcaagcgcaccgccgccggcatcatgaagaaccccacggtggacgggatcaccgtgatcgacctggagcccatcagctacgaccccaagttcgagaagcagctgggccaggtcatgctcctggtgctgtgcgccgggcagctcctgctgatgcggaccacctgggccttctgcgaggtgctcacgctggcgaccggcccgatcctgaccctctgggaggggaaccccggccgcttctggaacaccacgatcgccgtctccaccgccaacatcttccggggcagctacctggccggggccggcctggcgttctccctcatcaagaacgtgcagacgccccggcgggggaccggcacgaccggggagaccctgggcgagaagtggaagcgccagctgaacagcctcgaccggaaggagttcgaggagtacaagcgctccggcatcctggaggtggaccggaccgaggccaagagcgccctgaaggacgggtccaagatcaagcacgccgtcagccgcggctccagcaagatccggtggatcgtggagcgcgggatggtgaagcccaagggcaaggtcgtggacctcgggtgcggccgcggcgggtggagctactacatggccaccctgaagaacgtgacggaggtcaagggctacaccaagggcgggccggggcacgaggagcccatccccatggcgacctacggctggaacctggtgaagctccactccggcgtggacgtcttctacaagcccaccgagcaggtcgacacgctgctgtgcgacatcggggagagctccagcaacccgaccatcgaggagggccggaccctccgcgtgctgaagatggtcgagccctggctgtccagcaagcccgagttctgcatcaaggtgctgaacccctacatgccgaccgtcatcgaggagctcgagaagctgcagcggaagcacgggggcaacctggtgcgctgccccctctcccggaacagcacgcacgagatgtactgggtgtccggcgccagcgggaacatcgtctccagcgtgaacaccacctccaagatgctgctgaaccgcttcaccacgcggcaccgcaagcccacctacgagaaggacgtggacctcggcgccgggacccggagcgtctccaccgagacggagaagcccgacatgaccatcatcggccgccggctgcagcgcctgcaggaggagcacaaggagacctggcactacgaccaggagaacccgtaccggacctgggcctaccacgggagctacgaggcgccctccacgggcagcgcctccagcatggtgaacggcgtggtcaagctcctgaccaagccctgggacgtgatcccgatggtgacccagctggccatgaccgacacgacccccttcgggcagcagcgcgtcttcaaggagaaggtggacacccggacgccccagcccaagccgggcacgcgcatggtgatgaccaccaccgccaactggctctgggccctgctggggaagaagaagaacccccggctctgcacgcgcgaggagttcatcagcaaggtccggtccaacgcggccatcggcgccgtgttccaggaggagcaggggtggaccagcgcctccgaggccgtgaacgacagccgcttctgggagctggtcgacaaggagcgggcgctgcaccaggagggcaagtgcgagtcctgcgtgtacaacatgatgggcaagcgcgagaagaagctcggggagttcggccgcgccaaggggagccgggccatctggtacatgtggctgggcgcccgcttcctggagttcgaggccctcgggttcctgaacgaggaccactggttcggccgggagaactcctggagcggcgtggagggggagggcctgcaccgcctcgggtacatcctggaggagatcgacaagaaggacggcgacctgatgtacgcggacgacaccgccggctgggacacccggatcacggaggacgacctccagaacgaggagctggtcaccgagcagatggcgccccaccacaagatcctggccaaggcgatcttcaagctcacctaccagaacaaggtggtgaaggtcctgcgccccaccccgcgcggggccgtgatggacatcatctcccgcaaggaccagcggggcagcggccaggtgggcacctacgggctgaacacgttcaccaacatggaggtccagctcatccgccagatggaggccgagggcgtgatcacccaggacgacatgcagaaccccaagggcctgaaggagcgggtggagaagtggctgcgcgagtgcggggtcgaccggctcaagcgcatggccatctccggcgacgactgcgtggtgaagcccctggacgagcggttcgggaccagcctcctgttcctgaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctcatcggccgggcccgcatcagccagggggcgggctggtccctgcgcgagacggcctgcctggggaaggcctacgcccagatgtggagcctcatgtacttccaccggcgcgacctgcggctggccagcatggcgatctgctccgccgtgcccaccgagtggttcccgaccagccgcaccacgtggtccatccacgcccaccaccagtggatgaccaccgaggacatgctcaaggtgtggaaccgggtctggatcgaggacaaccccaacatgatcgacaagacccccgtgcacagctgggaggacatcccctacctgggcaagcgcgaggacctgtggtgcgggtccctcatcggcctgagctcccgggccacgtgggccaagaacatccacaccgcgatcacccaggtgcgcaacctgatcggcaaggaggagtacgtcgactacatgccggtgatgaagcggtacagcgccccctccgagagcgagggggtgctctga

SEQ ID NO: 10453 - RNA, 9867 nt, synthetic construct
  misc_feature 1..9867: note = derived and/or modified CDS sequence (opt1) from DENV-4__FJ226067__SS-prME
  source 1..9867: mol_type = other RNA
agcaccatcaccctgctctgcctgatccccaccgtgatggccttccacctgtccacccgggacggcgagccgctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcaccgtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacgcccctggcggagaacacgaactccgtgaccaacatcgagctggagccgcccttcggggacagctacatcgtcatcggcgtgggcaactccgccctcaccctgcactggttccggcgcgggagctccatcggcaagatgttcgagagcacctaccgcggggccaagcgcatggccatcctgggcgagacggcgtgggacttcgggtccgtgggcggcctcttcaccagcctggggaaggccgtccaccaggtgttcggctccgtgtacaccaccatgttcgggggcgtcagctggatgatccggatcctgatcgggttcctcgtgctgtggatcggcacgaactcccgcaacaccagcatggccatgacctgcatcaccgtgggcgggatcacgctgttcctgggcttcaccgtccaggccgacatggggtgcgtggtgtcctggagcggccgggagctcaagtgcgggagcggcatcttcgtcgtggacaacgtgcacacctggaccgagcagtacaagttccagcccgagtcccccgcccgcctggcgagcgccatcctgaacgcccacaaggacggcgtctgcgggatccggtccacgacccgcctcgagaacgtgatgtggaagcagatcaccaacgagctgaactacgccctgtgggagggcgggcacgacctcaccgtggtcgccggcgacgtgaagggcgtgctgacgaaggggaagcgggcgctgaccccgcccgtcagcgacctcaagtactcctggaagacctggggcaaggccaagatcttcacccccgaggcccgcaacagcacgttcctgatcgacgggcccgacacctccgagtgcccgaacgagcggcgcgcctggaacagcctggaggtggaggactacggcttcgggatgttcaccaccaacatctggatgaagttccgggagggctccagcgaggtgtgcgaccaccgcctcatgtccgccgcgatcaaggaccagaaggccgtccacgccgacatgggctactggatcgagagctccaagaaccagacgtggcagatcgagaaggccagcctgatcgaggtgaagacctgcctgtggcccaagacccacaccctctggtccaacggggtgctggagagccagatgctgatccccaagtcctacgcgggcccgttcagccagcacaactaccggcaggggtacgccacccagacggtcggcccctggcacctcgggaagctggagatcgacttcggcgagtgccccggcaccaccgtgaccatccaggaggactgcgaccaccgcgggcccagcctgcgcacgaccaccgcctccggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgtggtcgtgatcaccctgtgcgccatcatcctgggcgggctcacctggatggacctgctgcgcgcgctcatcatgctgggcgacacgatgtccggccggatcgggggccagatccacctggccatcatggccgtgttcaagatgagccccgggtacgtcctcggcgtgttcctgcgcaagctgacctcccgggagaccgccctcatggtgatcgggatggccatgaccacggtcctgagcatcccgcacgacctgatggagctcatcgacggcatctccctgggcctgatcctcctgaagatcgtgacccagttcgacaacacccaggtggggaccctggcgctcagcctgacgttcatccgctccaccatgcccctggtcatggcctggcggaccatcatggccgtcctcttcgtggtcaccctgatccccctgtgccgcacgagctgcctccagaagcagtcccactgggtggagatcaccgccctgatcctgggcgcccaggcgctccccgtgtacctgatgaccctgatgaagggggccagccggcgctcctggccgctcaacgagggcatcatggccgtcgggctggtgagcctgctcggctccgccctgctgaagaacgacgtgcccctcgcgggccccatggtcgccgggggcctgctgctcgccgcctacgtgatgagcgggagctccgccgacctgagcctggagaaggcggccaacgtgcagtgggacgagatggccgacatcaccggctccagccccatcatcgaggtcaagcaggacgaggacgggtccttcagcatccgggacgtggaggagacgaacatgatcaccctcctggtgaagctggccctcatcaccgtctccggcctgtacccgctggccatccccgtgaccatgacgctctggtacatgtggcaggtcaagacccagcgcagcggcgcgctgtgggacgtcccctcccccgccgccacccagaaggccgccctgagcgagggggtgtaccggatcatgcagcgcggcctcttcgggaagacccaggtgggcgtcgggatccacatggagggcgtgttccacaccatgtggcacgtgacgcggggctccgtcatctgccacgagaccgggcgcctggagccgagctgggcggacgtgcgcaacgacatgatctcctacggcgggggctggcggctgggcgacaagtgggacaaggaggaggacgtgcaggtcctcgccatcgagcccgggaagaaccccaagcacgtgcagaccaagcccggcctgttcaagaccctgacgggggagatcggcgccgtgaccctcgacttcaagccggggaccagcggctcccccatcatcaaccgcaagggcaaggtcatcgggctgtacggcaacggggtggtgaccaagagcggcgactacgtctccgccatcacgcaggccgagcggatcggggagcccgactacgaggtggacgaggacatcttccgcaagaagcggctgaccatcatggacctccacccgggcgcgggcaagaccaagcgcatcctgcccagcatcgtgcgggaggccctgaagcgccggctgcgcaccctcatcctggcccccacgcgggtcgtggccgcggagatggaggaggccctgcgcgggctccccatccggtaccagaccccggccgtgaagtccgagcacaccggccgcgagatcgtcgacctgatgtgccacgccaccttcacgacccggctgctcagcagcacccgcgtgcccaactacaacctgatcgtcatggacgaggcccacttcaccgacccctccagcgtggcggcccgggggtacatctccacgcgcgtggagatgggcgaggccgccgccatcttcatgaccgcgacgcccccgggggccaccgaccccttcccccagagcaactcccccatcgaggacatcgagcgggagatcccggagcgcagctggaacacgggcttcgactggatcaccgactaccagggcaagaccgtctggttcgtgccctccatcaaggccgggaacgacatcgccaactgcctgcgcaagagcggcaagaaggtgatccagctctcccggaagaccttcgacacggagtaccccaagaccaagctgaccgactgggacttcgtcgtgaccacggacatcagcgagatgggggccaacttccgcgcgggccgggtgatcgacccccgccggtgcctgaagccggtcatcctcaccgacgggcccgagcgcgtgatcctggccggccccatccccgtgaccccggcctccgccgcgcagcggcgcggccggatcgggcgcaaccccgcccaggaggacgaccagtacgtcttcagcggcgaccccctgaagaacgacgaggaccacgcccactggaccgaggccaagatgctcctggacaacatctacacgcccgaggggatcatcccgaccctgttcggccccgagcgggagaagacccaggccatcgacggcgagttccgcctccgcggggagcagcgcaagaccttcgtggagctgatgcggcgcggcgacctgcccgtgtggctctcctacaaggtcgcgagcgccgggatctcctacaaggaccgggagtggtgcttcacgggcgagcgcaacaaccagatcctggaggagaacatggaggtggagatctggacccgggagggggagaagaagaagctgcgcccccggtggctcgacgcccgcgtgtacgccgacccgatggccctgaaggacttcaaggagttcgcgagcggccgcaagtccatcaccctggacatcctcaccgagatcgccagcctgcccacctacctgtccagccgggccaagctcgccctggacaacatcgtcatgctgcacacgaccgagcgcggcgggcgggcctaccagcacgcgctcaacgagctgcccgagagcctggagaccctcatgctggtggccctgctcggcgccatgaccgccgggatcttcctgttcttcatgcagggcaaggggatcggcaagctgtccatgggcctcatcgcgatcgccgtggccagcgggctgctgtgggtcgccgagatccagccgcagtggatcgccgcgtccatcatcctcgagttcttcctgatggtgctgctcatccccgagcccgagaagcagcgcacgccccaggacaaccagctgatctacgtgatcctgaccatcctcaccatcatcggcctgatcgccgccaacgagatggggctgatcgagaagaccaagacggacttcggcttctaccaggtcaagaccgagaccaccatcctcgacgtggacctgcggccggccagcgcctggacgctgtacgcggtggccaccaccatcctcacccccatgctgcgccacacgatcgagaacacctccgccaacctgagcctcgccgccatcgcgaaccaggccgccgtcctgatggggctgggcaagggctggcccctccaccggatggacctgggggtgcccctgctcgccatgggctgctactcccaggtgaacccgaccaccctgacggccagcctggtcatgctcctggtgcactacgcgatcatcgggcccggcctgcaggccaaggccacccgcgaggcccagaagcggaccgcggccggcatcatgaagaaccccaccgtggacgggatcacggtcatcgacctcgagcccatctcctacgacccgaagttcgagaagcagctgggccaggtgatgctgctcgtgctgtgcgccgggcagctgctcctgatgcgcaccacctgggccttctgcgaggtcctgaccctcgccacgggccccatcctgaccctgtgggaggggaaccccggccggttctggaacaccaccatcgcggtgagcacggccaacatcttccgcggctcctacctcgccggggccggcctggccttcagcctgatcaagaacgcgcagacgccccggcgcgggaccggcaccacgggggagaccctcggcgagaagtggaagcggcagctgaactccctggaccgcaaggagttcgaggagtacaagcggagcggcatcctcgaggtggaccgcaccgaggccaagtccgccctgaaggacgggagcaagatcaagcacgccgtctcccggggcagctccaagatccgctggatcgtggagcgcgggatggtgaagccgaagggcaaggtcgtggacctggggtgcggccggggcgggtggagctactacatggccaccctcaagaacgtgaccgaggtcaagggctacacgaagggcgggcccgggcacgaggagcccatccccatggcgacctacggctggaacctggtgaagctgcacagcggcgtggacgtcttctacaagccgaccgagcaggtcgacaccctcctgtgcgacatcggggagtccagctccaaccccacgatcgaggagggccgcaccctgcgggtgctcaagatggtcgagccctggctgagctccaagcccgagttctgcatcaaggtgctgaacccgtacatgcccaccgtcatcgaggagctggagaagctccagcgcaagcacgggggcaacctggtgcggtgccccctgagccgcaactccacccacgagatgtactgggtgagcggcgcctccgggaacatcgtcagctccgtgaacacgaccagcaagatgctcctgaaccggttcaccacccgccaccggaagcccacgtacgagaaggacgtggacctgggcgccgggacccgctccgtcagcaccgagaccgagaagccggacatgacgatcatcggccggcgcctccagcggctgcaggaggagcacaaggagacctggcactacgaccaggagaacccctaccgcacctgggcctaccacgggtcctacgaggcgcccagcaccggctccgccagctccatggtgaacggcgtggtcaagctgctcacgaagccgtgggacgtgatccccatggtgacccagctggccatgaccgacaccacgcccttcgggcagcagcgggtcttcaaggagaaggtggacacccgcacgccccagccgaagcccggcacccggatggtgatgacgaccaccgccaactggctgtgggccctcctggggaagaagaagaacccccgcctgtgcacccgggaggagttcatcagcaaggtccgcagcaacgcggccatcggcgccgtgttccaggaggagcaggggtggacgtccgccagcgaggccgtgaacgactcccggttctgggagctcgtcgacaaggagcgcgcgctgcaccaggagggcaagtgcgagagctgcgtgtacaacatgatgggcaagcgcgagaagaagctgggggagttcggccgggccaaggggtcccgcgccatctggtacatgtggctcggcgcccggttcctggagttcgaggccctggggttcctcaacgaggaccactggttcggccgcgagaacagctggtccggcgtggagggggagggcctgcaccggctggggtacatcctcgaggagatcgacaagaaggacggcgacctgatgtacgcggacgacaccgccggctgggacacccgcatcaccgaggacgacctgcagaacgaggagctcatcacggagcagatggcgccccaccacaagatcctggccaaggcgatcttcaagctgacctaccagaacaaggtcgtgaaggtgctccggccgacgccccgcggggccgtcatggacatcatcagccggaaggaccagcggggctccggccaggtgggcacctacgggctgaacaccttcacgaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggccatcagcggcgacgactgcgtcgtgaagcccctcgacgagcgcttcgggacctccctgctgttcctcaacgacatgggcaaggtgcggaaggacatcccgcagtgggagcccagcaaggggtggaagaactggcaggaggtccccttctgctcccaccacttccacaagatcttcatgaaggacggccgcagcctggtggtgccctgccggaaccaggacgagctgatcggccgcgcccgcatctcccagggggcgggctggagcctccgggagaccgcctgcctggggaaggcctacgcccagatgtggtccctgatgtacttccaccgccgggacctccgcctggccagcatggcgatctgcagcgccgtcccgacggagtggttccccacctcccggaccacctggagcatccacgcccaccaccagtggatgacgaccgaggacatgctgaaggtgtggaaccgcgtgtggatcgaggacaaccccaacatgaccgacaagacccccgtccactcctgggaggacatcccgtacctcggcaagcgggaggacctgtggtgcgggagcctgatcggcctctccagccgcgccacgtgggccaagaacatccacaccgcgatcacccaggtgcggaacctgatcggcaaggaggagtacgtggactacatgcccgtcatgaagcgctactccgccctgagcgagtccgagggggtgctctga

SEQ ID NO: 10454 - RNA, 9867 nt, synthetic construct
  misc_feature 1..9867: note = derived and/or modified CDS sequence (opt1) from DENV-4__EU854299__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccaccggggagaccctcggcgagaagtggaagcgccagctgaacagcctggaccggaaggagttcgaggagtacaagcgctccggcatcctcgaggtggaccggacggaggccaagagcgccctgaaggacgggtccaagatcaagcacgccgtcagccgcggctccagcaagatccggtggatcgtggagcgcgggatggtgaagcccaagggcaaggtcgtggacctggggtgcggccgcggcgggtggtcctactacatggcgaccctcaagaacgtgaccgaggtcaagggctacaccaaggggggcccggggcacgaggagcccatccccatggccacgtacggctggaacctggtgaagctgcacagcggcgtggacgtcttctacaagcccaccgagcaggtggacaccctcctgtgcgacatcggggagagctccagcaacccgaccatcgaggagggccggacgctgcgcgtgctcaagatggtcgagccctggctgtccagcaagcccgagttctgcatcaaggtgctgaacccctacatgccgaccgtgatcgaggagctggagaagctccagcggaagcacgggggcaacctggtccgctgccccctgtcccggaacagcacccacgagatgtactgggtgtccggcgccagcgggaacatcgtctccagcgtgaacaccacgtccaagatgctcctgaaccgcttcaccacccggcaccgcaagcccacctacgagaaggacgtggacctgggcgccgggacgcggagcgtctccaccgagaccgagaagcccgacatgaccatcatcggccgccggctccagcgcctgcaggaggagcacaaggagacgtggcactacgaccaggagaacccgtaccggacctgggcgtaccacgggagctacgaggccccctccaccggcagcgcctccagcatggtgaacggcgtggtcaagctgctcaccaagccctgggacgtgatcccgatggtgacgcagctggccatgaccgacaccacccccttcgggcagcagcgcgtcttcaaggagaaggtggacacgcggaccccccagcccaagccgggcacccgcatggtgatgaccacgaccgccaactggctgtgggcgctcctggggaagaagaagaacccccggctgtgcacccgcgaggagttcatctccaaggtccggagcaacgccgccatcggcgccgtgttccaggaggagcaggggtggaccagcgcctccgaggcggtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggcgctggggttcctcaacgaggaccactggttcggccgggagaactcctggagcggcgtggagggggagggcctgcaccgcctggggtacatcctcgaggagatcgacaagaaggacggcgacctgatgtacgccgacgacacggccggctgggacacccggatcaccgaggacgacctgcagaacgaggagctcatcaccgagcagatggccccccaccacaagatcctggcgaaggccatcttcaagctgacctaccagaacaaggtcgtgaaggtgctccgccccacgccgcggggggccgtcatggacatcatctcccgcaaggaccagcggggcagcgggcaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggccatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcgcgcatcagccagggggccggctggtccctccgcgagaccgcctgcctggggaaggcctacgcccagatgtggagcctgatgtacttccaccggcgcgacctccggctggcgtccatggccatctgcagcgccgtccccaccgagtggttcccgacgagccgcaccacctggtccatccacgcccaccaccagtggatgaccacggaggacatgctgaaggtgtggaaccgggtgtggatcgaggacaaccccaacatgatcgacaagacccccgtccacagctgggaggacatcccctacctcggcaagcgcgaggacctgtggtgcgggtccctgatcggcctcagctcccgggccacctgggcgaagaacatccacaccgccatcacgcaggtgcgcaacctgatcggcaaggaggagtacgtggactacatgccggtcatgaagcggtacagcgccccctccgagagcgagggggtgctgtga

SEQ ID NO: 10455 - RNA, 9867 nt, synthetic construct
  misc_feature 1..9867: note = derived and/or modified CDS sequence (opt1) from DENV-4__FJ182016__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccaccggggagaccctcggcgagaagtggaagcgccagctgaacagcctggaccggaaggagttcgaggagtacaagcgctccggcatcctcgaggtggaccggacggaggccaagagcgccctgaaggacgggtccaagatcaagcacgccgtcagccgcggctccagcaagatccggtggatcgtggagcgcgggatggtgaagcccaagggcaaggtcgtggacctggggtgcggccgcggcgggtggtcctactacatggcgaccctcaagaacgtgaccgaggtccggggctacaccaaggggggcccggggcacgaggagcccatccccatggccacgtacggctggaacctggtgaagctgcacagcggcgtggacgtcttctacaagcccaccgagcaggtggacaccctcctgtgcgacatcggggagagctccagcaacccgaccatcgaggagggccgcacgctgcgggtgctcaagatggtcgagccctggctgtccagcaagcccgagttctgcatcaaggtgctgaacccctacatgccgaccgtgatcgaggagctggagaagctccagcgcaagcacgggggcaacctggtccggtgccccctgtcccgcaacagcacccacgagatgtactgggtgtccggcgccagcgggaacatcgtctccagcgtgaacaccacgtccaagatgctcctgaaccggttcaccacccgccaccggaagcccacctacgagaaggacgtggacctgggcgccgggacgcgcagcgtctccaccgagaccgagaagcccgacatgaccatcatcggccggcgcctccagcggctgcaggaggagcacaaggagacgtggcactacgaccaggagaacccgtaccgcacctgggcgtaccacgggagctacgaggccccctccaccggcagcgcctccagcatggtgaacggcgtggtcaagctgctcaccaagccctgggacgtgatcccgatggtgacgcagctggccatgaccgacaccacccccttcgggcagcagcgggtcttcaaggagaaggtggacacgcgcaccccccagcccaagccgggcacccggatggtgatgaccacgaccgccaactggctgtgggcgctcctggggaagaagaagaacccccgcctgtgcacccgggaggagttcatctccaaggtccgcagcaacgccgccatcggcgccgtgttccaggaggagcaggggtggaccagcgcctccgaggcggtgaacgacagccggttctgggagctcgtcgacaaggagcgcgccctgcaccaggagggcaagtgcgagtcctgcgtgtacaacatgatgggcaagcgcgagaagaagctgggggagttcggccgggccaaggggagccgcgccatctggtacatgtggctcggcgcccggttcctggagttcgaggcgctggggttcctcaacgaggaccactggttcggccgcgagaactcctggagcggcgtggagggggagggcctgcaccggctggggtacatcctcgaggagatcgacaagaaggacggcgacctgatgtacgccgacgacacggccggctgggacacccgcatcaccgaggacgacctgcagaacgaggagctcatcaccgagcagatggccccccaccacaagatcctggcgaaggccatcttcaagctgacctaccagaacaaggtcgtgaaggtgctccggcccacgccgcgcggggccgtcatggacatcatctcccggaaggaccagcgcggcagcgggcaggtgggcacctacgggctgaacaccttcaccaacatggaggtgcagctgatccggcagatggaggccgagggcgtcatcacgcaggacgacatgcagaaccccaagggcctcaaggagcgcgtggagaagtggctgcgggagtgcggggtggaccgcctgaagcggatggccatctccggcgacgactgcgtcgtgaagcccctcgacgagcgcttcgggaccagcctgctgttcctcaacgacatgggcaaggtgcggaaggacatcccccagtgggagccgtccaaggggtggaagaactggcaggaggtccccttctgcagccaccacttccaccgcatcttcatgaaggacggccggtccctggtggtgccctgccgcaaccaggacgagctgatcggccgcgcgcggatcagccagggggccggctggtccctccgcgagaccgcctgcctggggaaggcctacgcccagatgtggagcctgatgtacttccaccggcgcgacctccggctggcgtccatggccatctgcagcgccgtccccaccgagtggttcccgacgagccgcaccacctggtccatccacgcccaccaccagtggatgaccacggaggacatgctgaaggtgtggaaccgggtgtggatcgaggacaaccccaacatgatcgacaagacccccgtccacagctgggaggacatcccctacctcggcaagcgcgaggacctgtggtgcgggtccctgatcggcctcagctcccgggccacctgggcgaagaacatccacaccgccatcacgcaggtgcgcaacctgatcggcaaggaggagtacgtggactacatgccggtcatgaagcggtacagcgccccctccgagagcgagggggtgctgtga

SEQ ID NO: 10456 - RNA, 9867 nt, synthetic construct
  misc_feature 1..9867: note = derived and/or modified CDS sequence (opt1) from DENV-4__EU854300__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggaacggccgcgagctgaagtgcgggagcggcatcttcgtcgtggacaacgtgcacacctggaccgagcagtacaagttccagcccgagtcccccgcgcggctggccagcgccatcctcaacgcccacaaggacggcgtctgcgggatccgcagcacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgcctccgacctgaagtacagctggaagacctggggcaaggccaagatcttcacccccgagacgcggaactccaccttcctgatcgacgggcccgacaccagcgagtgcccgaacgagcgccgggcctggaactccttcgaggtggaggactacggcttcgggatgttcaccacgaacatctggatgaagttccgcgagggcagctccgaggtgtgcgaccaccggctcatgagcgccgcgatcaaggaccagaaggccgtccacgccgacatgggctactggatcgagtccagcaagaaccagacctggcagatcgagcgcgcctccctgatcgaggtgaagacctgcctgtggcccaagacccacaccctctggagcaacggggtgctggagtcccagatgctgatccccaagagctacgcgggcccgttctcccagcacaactaccggcaggggtacgccacgcagaccgtcggcccctggcacctcgggaagctggagatcgacttcggcgagtgccccggcaccaccgtgacgatccaggagaactgcgaccaccgcgggcccagcctgcgcaccaccaccgcctccggcaagctcgtgacgcagtggtgctgccggagctgcaccatgccgcccctgcgcttcctgggggaggacggctgctggtacgggatggagatccggcccctcagcgagaaggaggagaacatggtcaagtcccaggtgaccgccggccagggcaccagcgagacgttctccatggggctgctgtgcctcaccctgttcgtcgaggagtgcctgcgccggcgcgtgacccggaagcacatgatcctcgccgtggtcatcaccctgtgcgcgatcatcctgggcgggctcacgtggatggacctgctgcgcgccctcatcatgctgggcgacaccatgagcggccggatcgggggccagacccacctggccatcatggccgtgttcaagatgtcccccgggtacgtgctcggcgtcttcctgcgcaagctgaccagccgggagacggccctcatggtgatcgggatggcgatgaccaccaccctgtccatcccgcacgacctgatggagctcatcgacggcatcagcctgggcctgatcctcctgaagatcgtgacgcagttcgacaacacccaggtcgggaccctggccctctccctgaccttcatccgcagcacgatgtccctggtgatggcctggcggaccatcatggccgtgctcttcgtcgtgaccctgatccccctgtgccgcaccagctgcctccagaagcagtcccactgggtggagatcacggccctgatcctgggcgcgcaggccctccccgtctacctgatgaccctgatgaagggggccagccggcgctcctggcccctcaacgagggcatcatggccgtggggctggtgagcctgctcggctccgcgctgctgaagaacgacgtcccgctcgccggccccatggtggccgggggcctgctgctcgccgcctacgtgatgagcgggtccagcgcggacctgagcctggagaaggccgccaacgtccagtgggacgagatggccgacatcaccggctccagccccatcatcgaggtgaagcaggacgaggacgggtccttcagcatccgggacgtggaggagaccaacatgatcacgctcctggtcaagctggccctcatcaccgtgtccggcctgtaccccctggcgatcccgatcaccatgaccctctggtacatgtggcaggtgaagacccagcgcagcggcgccctgtgggacgtcccctcccccgccgccacgcagaaggccgcgctgagcgagggggtgtaccggatcatgcagcgcggcctcttcgggaagacccaggtgggcgtcgggatccacatcgagggcgtgttccacaccatgtggcacgtgacccggggctccgtcatctgccacgagacggggcgcctggagcccagctgggccgacgtgcgcaacgacatgatctcctacggcgggggctggcggctgggcgacaagtgggacaaggaggaggacgtgcaggtcctcgccatcgagccggggaagaaccccaagcacgtgcagaccaagcccggcctgttcaagaccctgaccggggagatcggcgccgtgacgctcgacttcaagcccgggaccagcggctccccgatcatcaaccgcaagggcaaggtcatcgggctgtacggcaacggggtggtgaccaagagcggcgactacgtctccgccatcacccaggcggagcggatcggggagcccgactacgaggtggacgaggacatcttccgcaagaagcggctgacgatcatggacctccaccccggcgccggcaagaccaagcgcatcctgccgagcatcgtgcgggaggccctgaagcgccggctgcgcaccctcatcctggcccccacccgggtcgtggcggccgagatggaggaggccctgcgcgggctccccatccggtaccagacgcccgccgtgaagtccgagcacaccggccgcgagatcgtcgacctgatgtgccacgccaccttcaccacgcggctgctcagctccacccgcgtgccgaactacaacctgatcgtgatggacgaggcgcacttcaccgaccccagcagcgtcgccgcccgggggtacatctccacccgcgtggagatgggcgaggccgccgcgatcttcatgacggccaccccccccggggccaccgacccgttcccccagagcaactcccccatcgaggacatcgagcgggagatccccgagcgcagctggaacaccggcttcgactggatcacggactaccagggcaagaccgtctggttcgtgccgtccatcaaggccgggaacgacatcgccaactgcctgcgcaagagcggcaagaaggtgatccagctctcccggaagaccttcgacaccgagtaccccaagacgaagctgaccgactgggacttcgtcgtgaccaccgacatcagcgagatgggggcgaacttccgcgccggccgggtgatcgacccccgccggtgcctgaagcccgtcatcctcacggacgggccggagcgcgtgatcctggccggccccatccccgtgacccccgcctccgcggcccagcggcgcggccggatcgggcgcaacctggcccaggaggacgaccagtacgtcttcagcggcgacccgctcaagaacgacgaggaccacgcccactggaccgaggccaagatgctgctggacaacatctacacccccgaggggatcatccccacgctcttcggccccgagcgggagaagacccaggcgatcgacggcgagttccgcctgcggggggagcagcgcaagaccttcgtggagctgatgcggcgcggcgacctcccggtgtggctgtcctacaaggtcgccagcgccgggatctcctacaaggaccgggagtggtgcttcaccggcgagcgcaacaaccagatcctggaggagaacatggaggtggagatctggacccgggagggggagaagaagaagctccgccccaagtggctggacgcccgggtgtacgccgaccccatggcgctgaaggacttcaaggagttcgccagcggccgcaagtccatcacgctcgacatcctgaccgagatcgccagcctgcccacctacctctccagccgcgccaagctggccctggacaacatcgtcatgctccacaccacggagcggggcgggcgcgcgtaccagcacgccctgaacgagctgccggagtccctcgagaccctgatgctggtggccctcctgggcgccatgaccgcggggatcttcctgttcttcatgcagggcaaggggatcggcaagctcagcatgggcctgatcaccatcgccgtggccagcgggctgctctgggtcgccgagatccagccccagtggatcgccgcgtccatcatcctggagttcttcctgatggtgctcctgatccccgagccggagaagcagcggacgccccaggacaaccagctgatctacgtgatcctcaccatcctgaccatcatcggcctgatcgccgccaacgagatggggctcatcgagaagaccaaggccgacttcggcttctaccaggtcaagacggagaccaccatcctggacgtggacctgcgccccgccagcgcgtggaccctctacgccgtggccacgaccatcctgacccccatgctgcggcacaccatcgagaacacgtccgccaacctcagcctggccgcgatcgccaaccaggccgccgtcctgatggggctcggcaagggctggccgctgcaccgcatggacctgggggtgcccctcctggccatgggctgctactcccaggtgaaccccaccaccctgaccgcgagcctcgtcatgctgctggtgcactacgccatcatcgggcccggcctccaggccaaggccacgcgggaggcgcagaagcgcaccgccgccggcatcatgaagaacccgaccgtggacgggatcaccgtcatcgacctggagcccatctcctacgaccccaagttcgagaagcagctgggccaggtgatgctcctggtgctgtgcgccgggcagctcctgctgatgcggacgacctgggccttctgcgaggtcctcaccctggcgaccggccccatcctgacgctctgggaggggaacccgggccgcttctggaacaccaccatcgccgtgagcaccgccaacatcttccggggctcctacctggccggggccggcctggcgttcagcctcatcaagaacgcccagacgccccgccgggggaccggcaccaccggggagaccctgggcgagaagtggaagcgccagctgaactccctcgaccggaaggagttcgaggagtacaagcgcagcggcatcctggaggtggaccggacggaggccaagtccgccctgaaggacgggagcaagatcaagcacgccgtctcccgcggcagctccaagatccggtggatcgtggagcgcgggatggtgaagcccaagggcaaggtcgtggacctcgggtgcggccgcggcgggtggagctactacatggcgaccctgaagaacgtgaccgaggtcaagggctacaccaaggggggccccgggcacgaggagccgatccccatggccacgtacggctggaacctggtgaagctccactccggcgtggacgtcttctacaagcccaccgagcaggtggacaccctgctgtgcgacatcggggagagcagctccaaccccaccatcgaggagggccggacgctccgcgtgctgaagatggtcgagccgtggctgagctccaagcccgagttctgcatcaaggtgctgaacccctacatgcccaccgtgatcgaggagctcgagaagctgcagcggaagcacgggggcaacctggtccgctgcccgctcagccggaactccacccacgagatgtactgggtgagcggcgcctccgggaacatcgtcagctccgtgaacaccacgagcaagatgctgctgaaccgcttcaccacccggcaccgcaagcccacctacgagaaggacgtggacctcggcgccgggacgcggtccgtcagcaccgagaccgagaagcccgacatgaccatcatcggccgccggctgcagcgcctgcaggaggagcacaaggagacgtggcactacgaccaggagaacccctaccggacctgggcgtaccacgggtcctacgaggccccgagcaccggctccgccagctccatggtgaacggcgtggtcaagctcctgaccaagccctgggacgtgatccccatggtgacgcagctggccatgaccgacaccaccccgttcgggcagcagcgcgtcttcaaggagaaggtggacacgcggaccccccagcccaagcccggcacccgcatggtgatgaccacgaccgccaactggctctgggcgctgctggggaagaagaagaacccgcggctctgcacccgcgaggagttcatcagcaaggtccggtccaacgccgccatcggcgccgtgttccaggaggagcaggggtggaccagcgccagcgaggcggtgaacgactcccgcttctgggagctggtcgacaaggagcgggccctgcaccaggagggcaagtgcgagagctgcgtgtacaacatgatgggcaagcgcgagaagaagctcggggagttcggccgcgccaaggggtcccgggccatctggtacatgtggctgggcgcccgcttcctggagttcgaggcgctcgggttcctgaacgaggaccactggttcggccgggagaacagctggtccggcgtggagggggagggcctgcaccgcctcgggtacatcctggaggagatcgacaagaaggacggcgacctgatgtacgccgacgacacggccggctgggacacccggatcaccgaggacgacctccagaacgaggagctgatcaccgagcagatggccccccaccacaagatcctggcgaaggccatcttcaagctcacctaccagaacaaggtcgtgaaggtgctgcgccccacgccccggggggccgtcatggacatcatcagccgcaaggaccagcggggctccgggcaggtgggcacctacgggctgaacaccttcaccaacatggaggtgcagctcatccgccagatggaggccgagggcgtcatcacgcaggacgacatgcagaacccgaagggcctgaaggagcgggtggagaagtggctgcgcgagtgcggggtggaccggctcaagcgcatggccatcagcggcgacgactgcgtcgtgaagcccctggacgagcggttcgggacctccctgctcttcctgaacgacatgggcaaggtgcgcaaggacatcccccagtgggagcccagcaaggggtggaagaactggcaggaggtcccgttctgctcccaccacttccacaagatcttcatgaaggacggccggagcctggtggtgccctgccgcaaccaggacgagctcatcggccgggcgcgcatctcccagggggccggctggagcctgcgcgagaccgcctgcctggggaaggcctacgcccagatgtggtccctcatgtacttccaccggcgcgacctgcggctggcgagcatggccatctgctccgccgtccccaccgagtggttccccacgagccgcaccacctggagcatccacgcccaccaccagtggatgaccacggaggacatgctcaaggtgtggaaccgggtgtggatcgaggacaacccgaacatgatcgacaagacccccgtccactcctgggaggacatcccctacctgggcaagcgcgaggacctgtggtgcgggagcctcatcggcctgtccagccgggccacctgggcgaagaacatccacaccgccatcacgcaggtgcgcaacctgatcggcaaggaggagtacgtggactacatgcccgtcatgaagcggtactccgccccgagcgagtccgagggggtgctctga

SEQ ID NO: 10457 - RNA, 9867 nt, synthetic construct
  misc_feature 1..9867: note = derived and/or modified CDS sequence (opt1) from DENV-4__FJ182017__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcgcctgggtcatgtacggcacctgcacccagtccggggagcggcgccgggagaagcgcagcgtggccctgaccccgcactccggcatgggcctcgagacgcgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtcttcttcgtgctgatgatgctggtggcgccctcctacggcatgcggtgcgtcggcgtggggaaccgcgacttcgtggagggcgtcagcgggggcgcctgggtggacctcgtgctggagcacggcgggtgcgtcacgaccatggcccagggcaagcccaccctggacttcgagctcaccaagacgaccgccaaggaggtggccctgctgcggacctactgcatcgaggcgctcatctccaacatcaccacggccacccgctgcccgacccagggggagccctacctgaaggaggagcaggaccagcagtacatctgccggcgcgacgtggtcgaccggggctgggggaacggctgcggcctgttcgggaagggcggggtggtgacctgcgccaagttcagctgctccggcaagatcacggggaacctcgtccagatcgagaacctggagtacaccgtggtggtcaccgtgcacaacggcgacacccacgccgtcggcaacgacacgagcaaccacggggtgaccgccaccatcaccccccgctcccccagcgtggaggtcaagctgccggactacggcgagctcacgctggactgcgagccccggtccgggatcgacttcaacgagatgatcctgatgaagatgaagaagaagacctggctcgtgcacaagcagtggttcctggacctgcccctcccctggaccaccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatcagcgcgacccccctggccgagaacacgaactccgtgaccaacatcgagctcgagccgcccttcggggacagctacatcgtcatcggcgtgggcaactccgccctgaccctgcactggttccggaaggggagctccatcggcaagatgttcgagagcacctaccgcggggccaagcggatggcgatcctcggcgagacggcctgggacttcgggtccgtgggcggcctgttcaccagcctggggaaggccgtccaccaggtgttcggctccgtgtacaccaccatgttcgggggcgtcagctggatgatccgcatcctcatcgggttcctggtgctgtggatcggcacgaactcccggaacaccagcatggccatgacctgcatcgccgtgggcgggatcaccctgttcctcggcttcacggtccaggcggacatggggtgcgtggtgtcctggagcggccgcgagctgaagtgcgggtccggcatcttcgtcgtggacaacgtgcacacctggaccgagcagtacaagttccagcccgagagccccgcccggctggccagcgccatcctcaacgcccacaaggacggcgtctgcgggatccgctccaccacgcggctggagaacgtgatgtggaagcagatcaccaacgagctgaactacgtgctctgggagggcgggcacgacctgaccgtcgtggcgggcgacgtgaagggcgtcctgaccaaggggaagcgcgccctcacgccgcccgccagcgacctgaagtactcctggaagacctggggcaaggccaagatcttcacccccgaggcccggaacagcaccttcctgatcgacgggcccgacacgtccgagtgcccgaacgagcgccgggcgtggaacagcttcgaggtggaggactacggcttcgggatgttcaccaccaacatctggatgaagttccgcgagggctccagcgaggtgtgcgaccaccggctcatgtccgccgccatcaaggaccagaaggccgtccacgcggacatgggctactggatcgagagctccaagaaccagacctggcagatcgagcgcgccagcctgatcgaggtgaagacgtgcctgtggcccaagacccacaccctctggtccaacggggtgctggagagccagatgctgatccccaagtcctacgccggcccgttcagccagcacaactaccggcaggggtacgccacccagaccgtcggcccctggcacctcgggaagctggagatcgacttcggcgagtgccccggcacgaccgtgaccatccaggagaactgcgaccaccgcgggccctccctgcgcaccacgaccgccagcggcaagctcgtgacccagtggtgctgccggagctgcaccatgccgcccctgcgcttcctgggggaggacggctgctggtacgggatggagatccggcccctctccgagaaggaggagaacatggtcaagagccaggtgacggcgggccagggcacctccgagaccttcagcatggggctgctgtgcctcaccctgttcgtcgaggagtgcctgcgccggcgcgtgacgcggaagcacatgatcctcgccgtggtcatcaccctgtgcgccatcatcctgggcgggctcacctggatggacctgctgcgcgccctcatcatgctgggcgacaccatgtccggccggatcgggggccagacgcacctggccatcatggcggtgttcaagatgagccccgggtacgtgctcggcgtcttcctgcgcaagctgacctcccgggagaccgccctcatggtgatcgggatggccatgaccacgaccctgagcatcccgcacgacctgatggagctcatcgacggcatctccctgggcctgatcctcctgaagatcgtgacccagttcgacaacacccaggtcgggacgctggccctcagcctgaccttcatccgctccaccatgagcctggtgatggcctggcggaccatcatggcggtgctcttcgtcgtgacgctgatccccctgtgccgcacctcctgcctccagaagcagagccactgggtggagatcaccgccctgatcctgggcgcccaggccctccccgtctacctgatgaccctgatgaagggggcgtcccggcgcagctggcccctcaacgagggcatcatggccgtggggctggtgtccctgctcggcagcgccctgctgaagaacgacgtcccgctcgccggccccatggtggccgggggcctgctgctcgcggcctacgtgatgtccgggagcagcgccgacctgtccctggagaaggccgccaacgtccagtgggacgagatggcggacatcacgggcagctcccccatcatcgaggtgaagcaggacgaggacgggagcttctccatccgggacgtggaggagaccaacatgatcaccctcctggtcaagctggccctcatcaccgtgagcggcctgtaccccctggccatcccgatcacgatgaccctctggtacatgtggcaggtgaagacccagcgctccggcgccctgtgggacgtccccagccccgccgcgacccagaaggccgccctgtccgagggggtgtaccggatcatgcagcgcggcctcttcgggaagacccaggtgggcgtcgggatccacatggagggcgtgttccacacgatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagaccaagcccggcctgttcaagacgctgaccggggagatcggcgcggtgaccctcgacttcaagcccgggacctccggcagcccgatcatcaaccgcaagggcaaggtcatcgggctgtacggcaacggggtggtgacgaagtccggcgactacgtcagcgccatcacccaggccgagcggatcggggagcccgactacgaggtggacgaggacatcttccgcaagaagcggctgaccatcatggacctccaccccggcgccggcaagaccaagcgcatcctgccgtccatcgtgcgggaggcgctgaagcgccggctgcgcacgctcatcctggcccccacccgggtcgtggccgccgagatggaggaggccctgcgcgggctccccatccggtaccagacccccgcggtgaagagcgagcacaccggccgcgagatcgtcgacctgatgtgccacgccacgttcaccacccggctgctctccagcacccgcgtgccgaactacaacctgatcgtgatggacgaggcccacttcacggaccccagctccgtcgccgcccgggggtacatcagcacccgcgtggagatgggcgaggcggccgccatcttcatgaccgccaccccccccggggccacggacccgttcccccagtccaacagccccatcgaggacatcgagcgggagatccccgagcgctcctggaacaccggcttcgactggatcaccgactaccagggcaagaccgtctggttcgtgccgagcatcaaggcggggaacgacatcgccaactgcctgcgcaagtccggcaagaaggtgatccagctcagccggaagacgttcgacaccgagtaccccaagaccaagctgaccgactgggacttcgtcgtgacgaccgacatctccgagatgggggccaacttccgcgccggccgggtgatcgacccccgccggtgcctgaagcccgtcatcctcaccgacgggccggagcgcgtgatcctggcgggccccatccccgtgacccccgccagcgccgcccagcggcgcggccggatcgggcgcaacccggcccaggaggacgaccagtacgtcttctccggcgaccccctgaagaacgacgaggaccacgcgcactggacggaggccaagatgctcctggacaacatctacacccccgaggggatcatccccaccctgttcggcccggagcgggagaagacccaggccatcgacggcgagttccgcctccggggggagcagcgcaagacgttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcgcgggtgtacgccgaccccatggccctgaaggacttcaaggagttcgcctccggccgcaagagcatcaccctggacatcctcaccgagatcgcctccctgccgacgtacctgagctcccgcgcgaagctcgccctggacaacatcgtcatgctgcacaccaccgagcggggcgggcgcgcctaccagcacgccctcaacgagctgcccgagagcctggagaccctcatgctggtggcgctgctcggcgccatgacggccgggatcttcctgttcttcatgcagggcaaggggatcggcaagctgagcatgggcctcatcaccatcgccgtggcctccgggctgctgtgggtcgcggagatccagccccagtggatcgccgccagcatcatcctcgagttcttcctgatggtgctgctcatcccggagcccgagaagcagcggaccccccaggacaaccagctgatctacgtgatcctgaccatcctcacgatcatcggcctgatcgccgccaacgagatggggctgatcgagaagaccaagaccgacttcggcttctaccaggtcaagaccgagacgaccatcctcgacgtggacctgcgccccgcgtccgcctggaccctgtacgccgtggccaccacgatcctcaccccgatgctgcggcacaccatcgagaacaccagcgccaacctgtccctcgcggccatcgccaaccaggccgccgtcctgatggggctgggcaagggctggcccctccaccgcatggacctgggggtgcccctgctcgcgatgggctgctacagccaggtgaaccccacgaccctgaccgcctccctggtcatgctcctggtgcactacgccatcatcgggccgggcctgcaggccaaggcgacccgggaggcccagaagcgcacggccgccggcatcatgaagaaccccaccgtggacgggatcaccgtcatcgacctcgagcccatcagctacgaccccaagttcgagaagcagctgggccaggtgatgctgctcgccctgtgcgcggggcagctgctcctgatgcggaccacgtgggccttctgcgaggtgctgaccctcgccaccggcccgatcctgaccctgtgggaggggaaccccggccgcttctggaacacgaccatcgccgtctccaccgccaacatcttccggggcagctacctcgcgggggccggcctggccttctccctgatcaagaacgcccagaccccccgccgggggacgggcaccaccggggagaccctcggcgagaagtggaagcgccagctgaacagcctggaccggaaggagttcgaggagtacaagcgctccggcatcctcgaggtggaccggaccgaggccaagagcgcgctgaaggacgggtccaagatcaagcacgccgtgagccgcggctccagcaagatccggtggatcgtcgagcgcgggatggtgaagcccaagggcaaggtggtcgacctggggtgcggccgcggcgggtggtcctactacatggccacgctcaagaacgtgaccgaggtgaagggctacaccaaggggggcccggggcacgaggagcccatccccatggccacctacggctggaacctggtcaagctgcacagcggcgtggacgtgttctacaagcccacggagcaggtcgacaccctcctgtgcgacatcggggagagctccagcaacccgaccatcgaggagggccggaccctgcgcgtgctcaagatggtggagccctggctgtccagcaagcccgagttctgcatcaaggtcctgaacccctacatgccgacggtgatcgaggagctggagaagctccagcggaagcacgggggcaacctggtgcgctgccccctgtcccggaacagcacccacgagatgtactgggtctccggcgcgagcgggaacatcgtgtccagcgtcaacaccacctccaagatgctcctgaaccgcttcacgacccggcaccgcaagcccacctacgagaaggacgtggacctgggcgccgggacccggagcgtgtccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtcaacggcgtggtgaagctgctcaccaagccctgggacgtcatcccgatggtgacccagctggcgatgacggacaccacccccttcgggcagcagcgcgtgttcaaggagaaggtcgacacccggacgccccagcccaagccgggcacccgcatggtgatgaccaccacggccaactggctgtgggccctcctggggaagaagaagaacccccggctgtgcacccgcgaggagttcatctccaaggtgcggagcaacgccgccatcggcgcggtcttccaggaggagcaggggtggaccagcgcctccgaggccgtgaacgacagccgcttctgggagctcgtggacaaggagcgggccctgcaccaggagggcaagtgcgagtcctgcgtctacaacatgatgggcaagcgcgagaagaagctgggggagttcggccgcgccaaggggagccgggcgatctggtacatgtggctcggcgcccgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgcgggctgggacacgcggatcaccgaggacgacctgcagaacgaggagctcatcaccgagcagatggccccccaccacaagatcctggccaaggccatcttcaagctgacctaccagaacaaggtggtcaaggtgctccgccccaccccgcggggggccgtgatggacatcatctcccgcaaggaccagcggggcagcgggcaggtcggcacgtacgggctgaacaccttcaccaacatggaggtgcagctgatccgccagatggaggcggagggcgtgatcacccaggacgacatgcagaaccccaagggcctcaaggagcgggtcgagaagtggctgcgcgagtgcggggtggaccggctgaagcgcatggccatctccggcgacgactgcgtggtcaagcccctcgacgagcggttcgggacgagcctgctgttcctcaacgacatgggcaaggtgcgcaaggacatcccccagtgggagccgtccaaggggtggaagaactggcaggaggtgcccttctgcagccaccacttccacaagatcttcatgaaggacggccggtccctggtcgtgccctgccgcaaccaggacgagctgatcggccgggcccgcatcagccagggggccggctggtccctccgcgagaccgcctgcctggggaaggcgtacgcccagatgtggagcctgatgtacttccaccggcgcgacctccggctggcctccatggccatctgcagcgccgtgcccaccgagtggttcccgaccagccgcacgacctggtccatccacgcgcaccaccagtggatgaccaccgaggacatgctgaaggtctggaaccgggtgtggatcgaggacaaccccaacatgatcgacaagacgcccgtgcacagctgggaggacatcccctacctcggcaagcgcgaggacctgtggtgcgggtccctgatcggcctcagctcccgggccacctgggccaagaacatccacaccgccatcacccaggtccgcaacctgatcggcaaggaggagtacgtggactacatgccggtgatgaagcggtacagcgccccctccgagagcgagggggtcctgtga

SEQ ID NO: 10458 - RNA, 9867 nt, synthetic construct
  misc_feature 1..9867: note = derived and/or modified CDS sequence (opt1) from DENV-4__EU854301__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccaccggcgccgacacgtccgaggtgcactggaactacaaggagcgcatggtcaccttcaaggtgccgcacgcgaagcggcaggacgtgaccgtcctcgggagccaggagggcgccatgcacagcgccctggccggcgccaccgaggtggactccggggacggcaaccacatgttcgcggggcacctgaagtgcaaggtgcgcatggagaagctccgcatcaagggcatgagctacacgatgtgctccggcaagttcagcatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatctccgccacgcccctggcggagaacaccaacagcgtgaccaacatcgagctggagccgcccttcggggactcctacatcgtcatcggcgtgggcaacagcgccctcaccctgcactggttccggaaggggtccagcatcggcaagatgttcgagtccacgtaccgcggggccaagcggatggccatcctgggcgagaccgcgtgggacttcgggagcgtgggcggcctcttcacctccctggggaaggccgtccaccagatcttcggcagcgtgtacaccacgatgttcgggggcgtgtcctggatgatccgcatcctgatcgggttcctcgtcctgtggatcggcaccaacagccggaacacctccatggccatgacctgcatcgccgtgggcgggatcacgctgttcctgggcttcaccgtgcaggccgacatggggtgcgtcgtgagctggtccggccgcgagctcaagtgcgggagcggcatcttcgtggtcgacaacgtgcacacctggaccgagcagtacaagttccagcccgagagccccgcgcggctggcctccgccatcctgaacgcccacaaggacggcgtgtgcgggatccgcagcacgacccggctcgagaacgtcatgtggaagcagatcaccaacgagctgaactacgtgctgtgggagggcgggcacgacctcaccgtggtcgccggcgacgtgaagggcgtgctgacgaaggggaagcgcgcgctgaccccgcccgcctccgacctcaagtacagctggaagacctggggcaaggccaagatcttcacccccgaggcccggaactccacgttcctgatcgacgggcccgacaccagcgagtgcccgaacgagcgccgggcctggaactccttcgaggtcgaggactacggcttcgggatgttcaccaccaacatctggatgaagttccgcgagggcagctccgaggtgtgcgaccaccggctgatgagcgcggccatcaaggaccagaaggccgtgcacgccgacatgggctactggatcgagtccagcaagaaccagacgtggcagatcgagcgcgcgtccctcatcgaggtcaagacctgcctgtggcccaagacccacaccctgtggagcaacggggtgctcgagtcccagatgctgatccccaagagctacgccggcccgttctcccagcacaactaccggcaggggtacgccacccagacggtgggcccctggcacctggggaagctcgagatcgacttcggcgagtgccccggcaccaccgtcaccatccaggagaactgcgaccaccgcgggcccagcctgcgcacgaccaccgccagcggcaagctggtgacccagtggtgctgccggtcctgcacgatgccgcccctccgcttcctgggggaggacggctgctggtacgggatggagatccggcccctgagcgagaaggaggagaacatggtgaagtcccaggtcaccgccggccagggcaccagcgagaccttctccatggggctcctgtgcctgacgctcttcgtggaggagtgcctgcgccggcgcgtcacccggaagcacatgatcctggcggtggtgatcaccctctgcgccatcatcctgggcgggctgacctggatggacctcctgcgcgccctgatcatgctcggcgacacgatgagcggccggatcgggggccagacccacctggccatcatggccgtcttcaagatgtcccccgggtacgtgctgggcgtgttcctccgcaagctgaccagccgggagaccgcgctgatggtcatcgggatggccatgacgaccaccctctccatcccgcacgacctgatggagctgatcgacggcatcagcctcggcctgatcctgctcaagatcgtgacccagttcgacaacacgcaggtggggaccctggccctgtccctcaccttcatccgcagcaccatgtccctggtcatggcctggcggacgatcatggccgtgctgttcgtggtcaccctcatccccctgtgccgcaccagctgcctgcagaagcagtcccactgggtggagatcaccgcgctcatcctgggcgcccaggccctgcccgtgtacctcatgacgctgatgaagggggccagccggcgctcctggcccctgaacgagggcatcatggcggtcgggctcgtgagcctgctgggctccgccctcctgaagaacgacgtgccgctggccggccccatggtcgccgggggcctcctgctggccgcgtacgtgatgagcgggagctccgccgacctcagcctggagaaggccgccaacgtgcagtgggacgagatggccgacatcaccggctccagccccatcatcgaggtcaagcaggacgaggacgggtccttcagcatccgggacgtggaggagaccaacatgatcaccctgctcgtgaagctggcgctgatcacggtctccggcctctaccccctggccatcccgatcaccatgaccctgtggtacatgtggcaggtgaagacccagcgcagcggcgccctctgggacgtgccctcccccgccgccacccagaaggcggccctgagcgagggggtctaccggatcatgcagcgcggcctgttcgggaagacgcaggtgggcgtggggatccacatggagggcgtcttccacaccatgtggcacgtgacccggggctccgtgatctgccacgagaccgggcgcctcgagcccagctgggccgacgtccgcaacgacatgatctcctacggcgggggctggcggctgggcgacaagtgggacaaggaggaggacgtgcaggtgctggccatcgagccggggaagaaccccaagcacgtccagacgaagcccggcctcttcaagaccctgaccggggagatcggcgccgtgaccctggacttcaagcccgggacgagcggctccccgatcatcaaccgcaagggcaaggtgatcgggctctacggcaacggggtcgtgaccaagagcggcgactacgtgtccgcgatcacccaggccgagcggatcggggagcccgactacgaggtcgacgaggacatcttccgcaagaagcggctgaccatcatggacctgcaccccggcgccggcaagacgaagcgcatcctcccgagcatcgtgcgggaggccctgaagcgccggctgcgcaccctgatcctcgcgcccacccgggtggtcgccgccgagatggaggaggccctgcgcgggctgcccatccggtaccagacccccgccgtgaagtccgagcacacgggccgcgagatcgtggacctcatgtgccacgcgaccttcaccacccggctgctgagcagcacgcgcgtcccgaactacaacctcatcgtgatggacgaggcccacttcaccgacccctccagcgtggccgcccgggggtacatctccacccgcgtcgagatgggcgaggccgcggccatcttcatgaccgccacgccccccggggccaccgacccgttcccccagagcaactcccccatcgaggacatcgagcgggagatccccgagcgcagctggaacaccggcttcgactggatcaccgactaccagggcaagacggtgtggttcgtcccgtccatcaaggccgggaacgacatcgcgaactgcctgcgcaagagcggcaagaaggtgatccagctgtcccggaagaccttcgacaccgagtaccccaagaccaagctcacggactgggacttcgtggtcaccaccgacatcagcgagatgggggccaacttccgcgccggccgggtgatcgacccccgccggtgcctgaagcccgtgatcctgaccgacgggccggagcgcgtcatcctcgccggccccatccccgtgacgcccgcgtccgccgcccagcggcgcggccggatcgggcgcaacccggcccaggaggacgaccagtacgtgttcagcggcgaccccctgaagaacgacgaggaccacgcccactggaccgaggcgaagatgctgctcgacaacatctacacccccgaggggatcatccccaccctgttcggcccggagcgggagaagacgcaggccatcgacggcgagttccgcctgcggggggagcagcgcaagaccttcgtcgagctcatgcggcgcggcgacctgcccgtgtggctgtcctacaaggtggccagcgccgggatctcctacaaggaccgggagtggtgcttcaccggcgagcgcaacaaccagatcctcgaggagaacatggaggtcgagatctggacccgggagggggagaagaagaagctgcgccccaagtggctggacgcccgggtgtacgcggaccccatggccctcaaggacttcaaggagttcgccagcggccgcaagtccatcaccctggacatcctgacggagatcgccagcctcccgacctacctgtccagccgcgccaagctggcgctcgacaacatcgtgatgctgcacaccaccgagcggggcgggcgcgcctaccagcacgccctgaacgagctccccgagagcctggagacgctgatgctcgtcgccctgctgggcgcgatgaccgccgggatcttcctcttcttcatgcagggcaaggggatgggcaagctgtccatgggcctgatcaccatcgccgtggccagcgggctcctgtgggtggccgagatccagccccagtggatcgcggcctccatcatcctggagttcttcctcatggtcctgctgatcccggagcccgagaagcagcggaccccccaggacaaccagctcatctacgtgatcctgacgatcctgaccatcatcggcctcatcgccgccaacgagatggggctgatcgagaagaccaagaccgacttcggcttctaccaggtgaagacggagaccaccatcctggacgtcgacctccgccccgccagcgcgtggaccctgtacgccgtggccacgaccatcctgaccccgatgctccggcacaccatcgagaacacgtccgccaacctgagcctggccgcgatcgccaaccaggccgccgtgctcatggggctgggcaagggctggcccctgcaccgcatggacctcggggtccccctgctggccatgggctgctactcccaggtgaaccccaccaccctcaccgcgagcctggtgatgctgctcgtccactacgccatcatcgggccgggcctgcaggccaaggccacgcgggaggcgcagaagcgcaccgccgccggcatcatgaagaaccccaccgtggacgggatcaccgtgatcgacctggagcccatctcctacgaccccaagttcgagaagcagctcggccaggtcatgctgctggtgctctgcgccgggcagctgttcctgatgcggacgacctgggccttctgcgaggtgctcaccctggcgaccggcccgatcctgacgctctgggaggggaaccccggccgcttctggaacaccaccatcgccgtcagcaccgccaacatcttccggggctcctacctggccggggccggcctggcgttcagcctcatcaagaacgcccagacgccccgccgggggaccggcaccaccggggagaccctgggcgagaagtggaagcgccagctgaactccctcgaccggaaggagttcgaggagtacaagcgcagcggcatcctggaggtggaccggacggaggccaagtccgccctgaaggacgggagcaagatcaagcacgccgtgtcccgcggcagctccaagatccggtggatcgtcgagcgcgggatggtgaagcccaagggcaaggtggtcgacctcgggtgcggccgcggcgggtggagctactacatggcgaccctgaagaacgtgaccgaggtgaagggctacaccaaggggggcccggggcacgaggagcccatccccatggccacgtacggctggaacctggtcaagctccacagcggcgtggacgtgttctacaagcccaccgagcaggtcgacaccctgctgtgcgacatcggggagtccagctccaacccgaccatcgaggagggccggacgctccgcgtgctgaagatggtggagccctggctgagctccaagcccgagttctgcatcaaggtcctcaacccctacatgccgaccgtgatcgaggagctggagaagctgcagcggaagcacgggggcaacctggtgcgctgccccctcagccggaactccacccacgagatgtactgggtcagcggcgcctccgggaacatcgtgagctccgtcaacaccacgagcaagatgctgctgaaccgcttcaccacccggcaccgcaagcccacctacgagaaggacgtggacctcggcgccgggacgcggtccgtgagcaccgagaccgagaagcccgacatgaccatcatcggccgccggctgcagcgcctgcaggaggagcacaaggagacgtggcactacgaccaggagaacccgtaccggacctgggcgtaccacgggtcctacgaggcccccagcaccggctccgccagctccatggtcaacggcgtggtgaagctcctgaccaagccctgggacgtcatcccgatggtgacgcagctggccatgaccgacaccacccccttcgggcagcagcgcgtgttcaaggagaaggtcgacacgcggaccccccagcccaagccgggcacccgcatggtgatgaccacgaccgccaactggctctgggcgctgctggggaagaagaagaacccccggctctgcacccgcgaggagttcatcagcaaggtgcggagcaacgccgccatcggcgccgtcttccaggaggagcaggggtggacctccgccagcgaggcggtgaacgactcccgcttctgggagctggtggacaaggagcgggccctgcaccaggagggcaagtgcgagagctgcgtctacaacatgatgggcaagcgcgagaagaagctcggggagttcggccgcgccaaggggtcccgggccatctggtacatgtggctgggcgcccgcttcctggagttcgaggcgctcgggttcctgaacgaggaccactggttcggccgggagaacagctggtccggcgtggagggggagggcctgcaccgcctcgggtacatcctggaggagatcgacaagaaggacggcgacctgatgtacgccgacgacacggccggctgggacacccggatcaccgaggacgacctccagaacgaggagctgatcaccgagcagatggccccccaccacaagatcctggcgaaggccatcttcaagctcacctaccagaacaaggtggtcaaggtgctgcgccccacgccgcggggggccgtgatggacatcatcagccgcaaggaccagcggggctccgggcaggtcggcacctacgggctgaacaccttcaccaacatggaggtgcagctcatccgccagatggaggccgagggcgtgatcacgcaggacgacatgcagaaccccaagggcctgaaggagcgggtcgagaagtggctgcgcgagtgcggggtggaccggctcaagcgcatggccatcagcggcgacgactgcgtggtcaagcccctggacgagcggttcgggacctccctgctcttcctgaacgacatgggcaaggtgcgcaaggacatcccccagtgggagccgagcaaggggtggaagaactggcaggaggtgcccttctgctcccaccacttccacaagatcttcatgaaggacggccggagcctggtcgtgccctgccgcaaccaggacgagctcatcggccgggcgcgcatctcccagggggccggctggagcctgcgcgagaccgcctgcctggggaaggcctacgcccagatgtggtccctcatgtacttccaccggcgcgacctgcggctggcgagcatggccatctgcagcgccgtgcccaccgagtggttcccgacgtcccgcaccacctggagcatccacgcccaccaccagtggatgaccacggaggacatgctcaaggtctggaaccgggtgtggatcgaggacaaccccaacatgatcgacaagacccccgtgcactcctgggaggacatcccctacctgggcaagcgcgaggacctgtggtgcgggagcctcatcggcctgtccagccgggccacctgggcgaagaacatccacaccgccatcacgcaggtccgcaacctgatcggcaaggaggagtacgtggactacatgccggccatgaagcggtactccgcccccagcgagtccgagggggtgctctga

SEQ ID NO: 10459 - RNA, 9867 nt, synthetic construct
  misc_feature 1..9867: note = derived and/or modified CDS sequence (opt1) from DENV-4__FJ639736__SS-prME
  source 1..9867: mol_type = other RNA
agcaccatgaccctgctctgcctgatccccacggccatggccttccacctgtccacccgcgacggcgagccgctcatgatcgtggcgaagcacgagcgggggcgccccctgctgttcaagaccaccgagggcatcaacaagtgcacgctcatcgccatggacctgggggagatgtgcgaggacaccgtcacctacaagtgccccctgctcgtgaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgctcatctccaacatcacgaccgccacccgctgcccgacccagggggagccctacctgaaggaggagcaggaccagcagtacatctgccggcgcgacgtggtggaccggggctgggggaacggctgcggcctgttcgggaagggcggggtcgtgacgtgcgccaagttcagctgctccggcaagatcaccgggaacctcgtgcagatcgagaacctggagtacaccgtcgtggtgaccgtccacaacggcgacacgcacgccgtgggcaacgacaccagcaaccacggggtcaccgccaccatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggaccgcgggcgccgacaccagcgaggtgcactggaactacaaggagcgcatggtgacgttcaaggtcccgcacgccaagcggcaggacgtgaccgtgctggggtcccaggagggcgccatgcacagcgccctggcgggcgccaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatcagctccacccccctggccgagaacacgaacagcgtgaccaacatcgagctcgagccgcccttcggggactcctacatcgtgatcggcgtcggcaacagcgccctgaccctgcactggttccggaaggggtccagcatcggcaagatgttcgagtccacctaccgcggggccaagcggatggcgatcctcggcgagacggcctgggacttcgggagcgtgggcggcctgttcacctccctggggaaggccgtgcaccaggtcttcggcagcgtgtacaccaccatgttcgggggcgtgtcctggatgatccgcatcctcatcgggttcctggtcctgtggatcggcacgaacagccggaacacctccatggccatgacctgcatcgccgtgggcgggatcaccctgttcctcggcttcacggtgcaggcggacatggggtgcgtcgtgagctggtccggccgcgagctgaagtgcgggagcggcatcttcgtggtcgacaacgtgcacacctggaccgagcagtacaagttccagcccgagagccccgcccggctggcctccgccatcctcaacgcccacaaggacggcgtgtgcgggatccgcagcaccacgcggctggagaacgtcatgtggaagcagatcaccaacgagctgaactacgtgctctgggagggcgggcacgacctgaccgtggtcgcgggcgacgtgaagggcgtgctgaccaaggggaagcgcgccctcacgccgcccgtctccgacctgaagtacagctggaagacctggggcaaggccaagatcttcacccccgaggcccggaactccaccttcctgatcgacgggcccgacacgagcgagtgcccgaacgagcgccgggcctggaactccctcgaggtggaggactacggcttcgggatgttcaccaccaacatctggatgaagttccgcgagggcagctccgaggtgtgcgaccaccggctgatgagcgcggccatcaaggaccagaaggccgtccacgccgacatgggctactggatcgagtccagcaagaaccagacctggcagatcgagcgcgcgtccctgatcgaggtgaagacgtgcctctggcccaagacccacaccctgtggagcaacggggtgctggagtcccagatgctcatccccaagagctacgccggcccgttctcccagcacaactaccggcaggggtacgccacccagaccgtcggcccctggcacctggggaagctggagatcgacttcggcgagtgccccggcacgaccgtgaccatccaggaggactgcgaccaccgcgggcccagcctccgcaccacgaccgccagcggcaagctggtgacccagtggtgctgccggtcctgcaccatgccgcccctgcgcttcctcggggaggacggctgctggtacgggatggagatccggcccctgagcgagaaggaggagaacatggtcaagtcccaggtgacggccggccagggcaccagcgagaccttctccatggggctgctctgcctgaccctgttcgtcgaggagtgcctccgccggcgcgtgacgcggaagcacatgatcctggcggtggtcatcaccctgtgcgccatcatcctcggcgggctgacctggatggacctgctccgcgccctgatcatgctgggcgacaccatgagcggccggatcgggggccagacgcacctcgccatcatggccgtgttcaagatgtcccccgggtacgtgctgggcgtcttcctgcgcaagctcaccagccgggagaccgcgctgatggtgatcgggatggccatgaccacgaccctgtccatcccgcacgacctcatggagctgatcgacggcatcagcctgggcctcatcctgctgaagatcgtgacccagttcgacaacacccaggtcgggacgctcgccctgtccctgaccttcatccgcagcaccatgtccctcgtgatggcctggcggaccatcatggccgtgctgttcgtcgtgacgctgatccccctctgccgcaccagctgcctgcagaagcagtcccactgggtggagatcaccgcgctgatcctcggcgcccaggccctgcccgtctacctgatgaccctcatgaagggggccagccggcgctcctggcccctgaacgagggcatcatggcggtggggctggtgagcctcctgggctccgccctgctcaagaacgacgtcccgctggccggccccatggtggccgggggcctgctcctggccgcgtacgtgatgagcgggagctccgccgacctgagcctcgagaaggccgccaacgtccagtgggacgagatggccgacatcacgggctccagccccatcatcgaggtgaagcaggacgaggacgggtccttcagcatccgggacgtggaggagaccaacatgatcaccctgctggtcaagctcgcgctgatcaccgtgtccggcctgtaccccctcgccatcccggtgacgatgaccctgtggtacatgtggcaggtcaagacccagcgcagcggcgccctgtgggacgtgccctcccccgccgccacccagaaggcggccctcagcgagggggtgtaccggatcatgcagcgcggcctgttcgggaagacccaggtcggcgtggggatccacatggagggcgtgttccacacgatgtggcacgtcacccggggctccgtgatctgccacgagaccgggcgcctggagcccagctgggccgacgtgcgcaacgacatgatctcctacggcgggggctggcggctcggcgacaagtgggacaaggaggaggacgtccaggtgctggccatcgagccggggaagaaccccaagcacgtgcagaccaagcccggcctgttcaagacgctcaccggggagatcggcgccgtcaccctggacttcaagcccgggaccagcggctccccgatcatcaaccgcaagggcaaggtgatcgggctgtacggcaacggggtggtcacgaagagcggcgactacgtgtccgcgatcacccaggccgagcggatcggggagcccgactacgaggtggacgaggacatcttccgcaagaagcggctcaccatcatggacctgcaccccggcgccggcaagaccaagcgcatcctgccgagcatcgtccgggaggccctgaagcgccggctccgcacgctgatcctggcgcccacccgggtggtggccgccgagatggaggaggccctccgcgggctgcccatccggtaccagacccccgccgtcaagtccgagcacaccggccgcgagatcgtggacctgatgtgccacgcgacgttcaccacccggctcctgagcagcacccgcgtgccgaactacaacctgatcgtcatggacgaggcccacttcacggacccctccagcgtggccgcccgggggtacatctccacccgcgtcgagatgggcgaggccgcggccatcttcatgaccgccaccccccccggggccacggacccgttcccccagagcaactcccccatcgaggacatcgagcgggagatccccgagcgcagctggaacaccggcttcgactggatcaccgactaccagggcaagaccgtgtggttcgtgccgtccatcaaggccgggaacgacatcgcgaactgcctccgcaagagcggcaagaaggtcatccagctgtcccggaagacgttcgacaccgagtaccccaagaccaagctgaccgactgggacttcgtggtgacgaccgacatcagcgagatgggggccaacttccgcgccggccgggtcatcgacccccgccggtgcctcaagcccgtgatcctgaccgacgggccggagcgcgtgatcctggccggccccatccccgtcacccccgcgtccgccgcccagcggcgcggccggatcgggcgcaacccggcccaggaggacgaccagtacgtgttcagcggcgaccccctcaagaacgacgaggaccacgcccactggacggaggcgaagatgctgctggacaacatctacacccccgaggggatcatccccaccctcttcggcccggagcgggagaagacccaggccatcgacggcgagttccgcctgcggggggagcagcgcaagacgttcgtggagctgatgcggcgcggcgacctccccgtctggctgtcctacaaggtggccagcgccgggatctcctacaaggaccgggagtggtgcttcaccggcgagcgcaacaaccagatcctggaggagaacatggaggtggagatctggacccgggagggggagaagaagaagctccgcccccggtggctggacgcccgcgtctacgcggaccccatggccctgaaggacttcaaggagttcgccagcggccgcaagtccatcaccctcgacatcctgaccgagatcgccagcctgccgacgtacctctccagccgggccaagctggcgctggacaacatcgtgatgctccacaccaccgagcgcggcgggcgggcctaccagcacgccctgaacgagctgcccgagagcctcgagaccctgatgctggtggccctcctgggcgcgatgacggccgggatcttcctgttcttcatgcagggcaaggggatcggcaagctctccatgggcctgatcaccatcgccgtcgccagcgggctgctctgggtggccgagatccagccccagtggatcgcggcctccatcatcctggagttcttcctgatggtgctcctgatcccggagcccgagaagcagcgcaccccccaggacaaccagctgatctacgtcatcctcaccatcctgacgatcatcggcctgatcgccgccaacgagatggggctcatcgagaagaccaagaccgacttcggcttctaccaggtgaagaccgagacgaccatcctggacgtggacctgcggcccgccagcgcgtggaccctctacgccgtcgccaccacgatcctgaccccgatgctgcgccacaccatcgagaacacctccgccaacctcagcctggccgcgatcgccaaccaggccgccgtgctgatggggctcggcaagggctggcccctgcaccggatggacctgggggtgcccctcctggccatgggctgctactcccaggtcaaccccacgaccctgaccgcgagcctcgtgatgctgctggtgcactacgccatcatcgggccgggcctccaggccaaggccacccgcgaggcgcagaagcggacggccgccggcatcatgaagaaccccaccgtcgacgggatcaccgtgatcgacctggagcccatctcctacgaccccaagttcgagaagcagctgggccaggtgatgctcctggtcctgtgcgccgggcagctcctgctgatgcgcaccacgtgggccttctgcgaggtgctcaccctggcgaccggcccgatcctgaccctctgggaggggaaccccggccggttctggaacacgaccatcgccgtgagcaccgccaacatcttccgcggctcctacctggccggggccggcctggcgttcagcctcatcaagaacgcccagaccccccggcgcgggacgggcaccaccggggagaccctgggcgagaagtggaagcggcagctgaactccctcgaccgcaaggagttcgaggagtacaagcggagcggcatcctggaggtcgaccgcaccgaggccaagtccgccctgaaggacgggagcaagatcaagcacgccgtgtcccggggcagctccaagatccgctggatcgtggagcgcgggatggtcaagcccaagggcaaggtggtggacctcgggtgcggccggggcgggtggagctactacatggcgacgctgaagaacgtcaccgaggtgaagggctacaccaaggggggcccggggcacgaggagcccatccccatggccacctacggctggaacctggtgaagctccacagcggcgtcgacgtgttctacaagcccacggagcaggtggacaccctgctgtgcgacatcggggagtccagctccaacccgaccatcgaggagggccgcaccctccgggtcctgaagatggtggagccctggctgagctccaagcccgagttctgcatcaaggtgctgaacccctacatgccgacggtcatcgaggagctcgagaagctgcagcgcaagcacgggggcaacctggtgcggtgccccctcagccgcaactccacccacgagatgtactgggtcagcggcgcctccgggaacatcgtgagctccgtgaacaccaccagcaagatgctgctgaaccggttcacgacccgccaccggaagcccacctacgagaaggacgtcgacctcggcgccgggacccgctccgtgagcacggagaccgagaagcccgacatgaccatcatcggccggcgcctgcagcggctgcaggaggagcacaaggagacctggcactacgaccaggagaacccgtaccgcacgtgggcgtaccacgggtcctacgaggcccccagcaccggctccgccagctccatggtgaacggcgtcgtgaagctcctgaccaagccctgggacgtgatcccgatggtcacccagctggccatgacggacaccacccccttcgggcagcagcgggtgttcaaggagaaggtggacacccgcacgccccagcccaagccgggcacccggatggtcatgaccaccacggccaactggctctgggcgctgctggggaagaagaagaacccccgcctctgcacccgggaggagttcatcagcaaggtgcgcagcaacgccgccatcggcgccgtgttccaggaggagcaggggtggacctccgccagcgaggcggtcaacgactcccggttctgggagctggtggacaaggagcgcgccctgcaccaggagggcaagtgcgagagctgcgtgtacaacatgatgggcaagcgcgagaagaagctcggggagttcggccgggccaaggggtcccgcgccatctggtacatgtggctgggcgcccggttcctggagttcgaggcgctcgggttcctgaacgaggaccactggttcggccgcgagaacagctggtccggcgtcgagggggagggcctgcaccggctcgggtacatcctggaggagatcgacaagaaggacggcgacctgatgtacgccgacgacaccgccggctgggacacgcgcatcaccgaggacgacctccagaacgaggagctgatcaccgagcagatggccccccaccacaagatcctggcgaaggccatcttcaagctcacctaccagaacaaggtggtgaaggtcctgcggcccaccccgcgcggggccgtgatggacatcatcagccggaaggaccagcgcggctccgggcaggtgggcacgtacgggctgaacaccttcaccaacatggaggtccagctcatccggcagatggaggccgagggcgtgatcacccaggacgacatgcagaaccccaagggcctgaaggagcgcgtggagaagtggctgcgggagtgcggggtcgaccgcctcaagcggatggccatcagcggcgacgactgcgtggtgaagcccctggacgagcgcttcgggacgtccctgctcttcctgaacgacatgggcaaggtccggaaggacatcccccagtgggagccgagcaaggggtggaagaactggcaggaggtgcccttctgctcccaccacttccacaagatcttcatgaaggacggccgcagcctggtggtcccctgccggaaccaggacgagctcatcggccgcgcgcgcatctcccagggggccggctggagcctgcgggagaccgcctgcctggggaaggcctacgcccagatgtggtccctcatgtacttccaccgccgggacctgcgcctggcgagcatggccatctgcagcgccgtgcccaccgagtggttcccgacctcccggacgacctggagcatccacgcccaccaccagtggatgaccaccgaggacatgctcaaggtgtggaaccgcgtctggatcgaggacaaccccaacatgatcgacaagacgcccgtgcactcctgggaggacatcccctacctgggcaagcgggaggacctgtggtgcgggagcctcatcggcctgtccagccgcgccacctgggcgaagaacatccacaccgccatcacccaggtgcggaacctgatcggcaaggaggagtacgtcgactacatgccggtgatgaagcgctactccgcccccagcgagtccgagggggtgctctga

SEQ ID NO: 10460 - RNA, 9867 nt, synthetic construct
  misc_feature 1..9867: note = derived and/or modified CDS sequence (opt1) from DENV-4__FJ639737__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcatcaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtcctgatgatgctggtggccccctcctacggcatgcggtgcgtgggcgtcgggaaccgcgacttcgtggagggcgtgagcgggggcgcgtgggtcgacctcgtgctggagcacggcgggtgcgtgaccaccatggcccagggcaagcccaccctggacttcgagctcacgaagaccaccgccaaggaggtcgccctgctgcggacctactgcatcgaggccctcatctccaacatcacgaccgcgacccgctgcccgacccagggggagccctacctgaaggaggagcaggaccagcagtacatctgccggcgcgacgtggtggaccggggctgggggaacggctgcggcctgttcgggaagggcggggtcgtgacgtgcgccaagttcagctgctccggcaagatcaccgggaacctcgtgcagatcgagaacctggagtacaccgtcgtggtgaccgtccacaacggcgacacgcacgccgtgggcaacgacaccagcaaccacggggtcaccgccaccatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggaccgccggcgcggacaccagcgaggtgcactggaactacaaggagcgcatggtgacgttcaaggtcccgcacgccaagcggcaggacgtgaccgtgctggggtcccaggagggcgccatgcacagcgccctggccggcgcgaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgccggggccccctgcaaggtgcccatcgagatccgggacgtcaacaaggagaaggtggtgggccgcgtcatcagctccacccccctggcggagaacacgaacagcgtgaccaacatcgagctcgagccgcccttcggggactcctacatcgtgatcggcgtcggcaacagcgccctgaccctgcactggttccggaaggggtccagcatcggcaagatgttcgagtccacctaccgcggggccaagcggatggccatcctcggcgagacggcgtgggacttcgggagcgtgggcggcctgttcacctccctggggaaggccgtgcaccaggtcttcggcagcgtgtacaccaccatgttcgggggcgtgtcctggatgatccgcatcctcatcgggttcctggtcctgtggatcggcacgaacagccggaacacctccatggccatgacctgcatcgccgtgggcgggatcaccctgttcctcggcttcacggtgcaggccgacatggggtgcgtcgtgagctggtccggccgcgagctgaagtgcgggagcggcatcttcgtggtcgacaacgtgcacacctggaccgagcagtacaagttccagcccgagagccccgcgcggctggcctccgccatcctcaacgcccacaaggacggcgtgtgcgggatccgcagcaccacgcggctggagaacgtcatgtggaagcagatcaccaacgagctgaactacgtgctctgggagggcgggcacgacctgaccgtggtcgccggcgacgtgaagggcgtgctgaccaaggggaagcgcgcgctcacgccgcccgtctccgacctgaagtacagctggaagacctggggcaaggccaagatcttcacccccgaggcccggaactccaccttcctgatcgacgggcccgacacgagcgagtgcccgaacgagcgccgggcctggaactccctcgaggtggaggactacggcttcgggatgttcaccaccaacatctggatgaagttccgcgagggcagctccgaggtgtgcgaccaccggctgatgagcgccgcgatcaaggaccagaaggccgtccacgccgacatgggctactggatcgagtccagcaagaaccagacctggcagatcgagcgcgcctccctgatcgaggtgaagacgtgcctctggcccaagacccacaccctgtggagcaacggggtgctggagtcccagatgctcatccccaagagctacgcgggcccgttctcccagcacaactaccggcaggggtacgccacccagaccgtcggcccctggcacctggggaagctggagatcgacttcggcgagtgccccggcacgaccgtgaccatccaggaggactgcgaccaccgcgggcccagcctccgcaccacgaccgccagcggcaagctggtgacccagtggtgctgccggtcctgcaccatgccgcccctgcgcttcctcggggaggacggctgctggtacgggatggagatccggcccctgagcgagaaggaggagaacatggtcaagtcccaggtgacggccggccagggcaccagcgagaccttctccatggggctgctctgcctgaccctgttcgtcgaggagtgcctccgccggcgcgtgacgcggaagcacatgatcctggccgtggtcatcaccctgtgcgcgatcatcctcggcgggctgacctggatggacctgctccgcgccctgatcatgctgggcgacaccatgagcggccggatcgggggccagacgcacctcgccatcatggccgtgttcaagatgtcccccgggtacgtgctgggcgtcttcctgcgcaagctcaccagccgggagaccgccctgatggtgatcgggatggcgatgaccacgaccctgtccatcccgcacgacctcatggagctgatcgacggcatcagcctgggcctcatcctgctgaagatcgtgacccagttcgacgacacccaggtcgggacgctcgccctgtccctgaccttcatccgcagcaccatgtccctcgtgatggcctggcggaccatcatggccgtgctgttcgtcgtgacgctgatccccctctgccgcaccagctgcctgcagaagcagtcccactgggtggagatcaccgccctgatcctcggcgcgcaggccctgcccgtctacctgatgaccctcatgaagggggccagccggcgctcctggcccctgaacgagggcatcatggccgtggggctggtgagcctcctgggctccgcgctgctcaagaacgacgtcccgctggccggccccatggtggccgggggcctgctcctggccgcctacgtgatgagcgggagctccgcggacctgagcctcgagaaggccgcctccgtccagtgggacgagatggccgacatcacgggcagctcccccatcatcgaggtgaagcaggacgaggacgggagcttctccatccgggacgtggaggagaccaacatgatcaccctgctggtcaagctcgccctgatcaccgtgagcggcctgtaccccctcgcgatcccggtgacgatgaccctgtggtacatgtggcaggtcaagacccagcgctccggcgccctgtgggacgtgcccagccccgccgccacccagaaggccgcgctctccgagggggtgtaccggatcatgcagcgcggcctgttcgggaagacccaggtcggcgtggggatccacatcgagggcgtgttccacacgatgtggcacgtcacccggggcagcgtgatctgccacgagaccgggcgcctggagccctcctgggccgacgtgcgcaacgacatgatcagctacggcgggggctggcggctcggcgacaagtgggacaaggaggaggacgtccaggtgctggccatcgagccggggaagaaccccaagcacgtgcagaccaagcccggcctgttcaagacgctcaccggggagatcggcgccgtcaccctggacttcaagcccgggacctccggcagcccgatcatcaaccgcaagggcaaggtgatcgggctgtacggcaacggggtggtcacgaagtccggcgactacgtgagcgccatcacccaggcggagcggatcggggagcccgactacgaggtggacgaggacatcttccgcaagaagcggctcaccatcatggacctgcaccccggcgccggcaagaccaagcgcatcctgccgtccatcgtccgggaggccctgaagcgccggctccgcacgctgatcctggcccccacccgggtggtggcggccgagatggaggaggccctccgcgggctgcccatccggtaccagacccccgccgtcaagagcgagcacaccggccgcgagatcgtggacctgatgtgccacgccacgttcaccacccggctcctgagctccacccgcgtgccgaactacaacctgatcgtcatggacgaggcgcacttcacggaccccagctccgtggccgcccgggggtacatcagcacccgcgtcgagatgggcgaggccgccgcgatcttcatgaccgccaccccccccggggccacggacccgttcccccagtccaacagccccatcgaggacatcgagcgggagatccccgagcgctcctggaacaccggcttcgactggatcaccgactaccagggcaagaccgtgtggttcgtgccgagcatcaaggccgggaacgacatcgccaactgcctccgcaagtccggcaagaaggtcatccagctgagccggaagacgttcgacaccgagtaccccaagaccaagctgaccgactgggacttcgtggtgacgaccgacatctccgagatgggggcgaacttccgcgccggccgggtcatcgacccccgccggtgcctcaagcccgtgatcctgaccgacgggccggagcgcgtgatcctggccggccccatccccgtcacccccgccagcgcggcccagcggcgcggccggatcgggcgcaacccggcccaggaggacgaccagtacgtgttctccggcgaccccctcaagaacgacgaggaccacgcccactggacggaggccaagatgctgctggacaacatctacacccccgaggggatcatccccaccctcttcggcccggagcgggagaagacccaggcgatcgacggcgagttccgcctgcggggggagcagcgcaagacgttcgtggagctgatgcggcgcggcgacctccccgtctggctgagctacaaggtggcctccgccgggatcagctacaaggaccgggagtggtgcttcaccggcgagcgcaacaaccagatcctggaggagaacatggaggtggagatctggacccgggagggggagaagaagaagctccgcccccggtggctggacgcccgcgtctacgccgaccccatggcgctgaaggacttcaaggagttcgcctccggccgcaagagcatcaccctcgacatcctgaccgagatcgcctccctgccgacgtacctcagcagccgggccaagctggccctggacaacatcgtgatgctccacaccaccgagcgcggcgggcgggcgtaccagcacgccctgaacgagctgcccgagtccctcgagaccctgatgctggtggccctcctgggcgccatgacggcggggatcttcctgttcttcatgcagggcaaggggatcggcaagctcagcatgggcctgatcaccatcgccgtcgcctccgggctgctctgggtggccgagatccagccccagtggatcgccgcgagcatcatcctggagttcttcctgatggtgctcctgatcccggagcccgagaagcagcgcaccccccaggacaaccagctgatctacgtcatcctcaccatcctgacgatcatcggcctgatcgccgccaacgagatggggctcatcgagaagaccaagaccgacttcggcttctaccaggtgaagaccgagacgaccatcctggacgtggacctgcggcccgcctccgcctggaccctctacgcggtcgccaccacgatcctgaccccgatgctgcgccacaccatcgagaacaccagcgccaacctctccctggccgccatcgcgaaccaggccgccgtgctgatggggctcggcaagggctggcccctgcaccggatggacctgggggtgcccctcctggccatgggctgctacagccaggtcaaccccacgaccctgaccgcctccctcgtgatgctgctggtgcactacgcgatcatcgggccgggcctccaggccaaggccacccgcgaggcccagaagcggacggcggccggcatcatgaagaaccccaccgtcgacgggatcaccgtgatcgacctggagcccatcagctacgaccccaagttcgagaagcagctgggccaggtgatgctcctggtcctgtgcgccgggcagctcctgctgatgcgcaccacgtgggccttctgcgaggtgctcaccctggccaccggcccgatcctgaccctctgggaggggaaccccggccggttctggaacacgaccatcgcggtgtccaccgccaacatcttccgcggcagctacctggccggggccggcctggccttctccctcatcaagaacgcgcagaccccccggcgcgggacgggcaccaccggggagaccctgggcgagaagtggaagcggcagctgaacagcctcgaccgcaaggagttcgaggagtacaagcggtccggcatcctggaggtcgaccgcaccgaggccaagagcgccctgaaggacgggtccaagatcaagcacgccgtgagccggggctccagcaagatccgctggatcgtggagcgcgggatggtcaagcccaagggcaaggtggtggacctcgggtgcggccggggcgggtggagctactacatggccacgctgaagaacgtcaccgaggtgaagggctacaccaaggggggcccggggcacgaggagcccatccccatggcgacctacggctggaacctggtgaagctccactccggcgtcgacgtgttctacaagcccatcgagcaggtggacacgctgctgtgcgacatcggggagagctccagcaacccgaccatcgaggagggccgcaccctccgggtcctgaagatggtggagccctggctgtccagcaagcccgagttctgcatcaaggtgctgaacccctacatgccgaccgtcatcgaggagctcgagaagctgcagcgcaagcacgggggcaacctggtgcggtgccccctctcccgcaacagcacgcacgagatgtactgggtctccggcgccagcgggaacatcgtgtccagcgtgaacaccacctccaagatgctgctgaaccggttcaccacgcgccaccggaagcccacctacgagaaggacgtcgacctcggcgccgggacccgcagcgtgtccaccgagacggagaagcccgacatgaccatcatcggccggcgcctgcagcggctgcaggaggagcacaaggagacctggcactacgaccaggagaacccgtaccgcacctgggcctaccacgggagctacgaggcgccctccacgggcagcgcctccagcatggtgaacggcgtcgtgaagctcctgaccaagccctgggacgtgatcccgatggtcacccagctggccatgaccgacacgacccccttcgggcagcagcgggtgttcaaggagaaggtggacacccgcaccccccagcccaagccgggcacgcggatggtcatgaccaccaccgccaactggctctgggccctgctggggaagaagaagaacccccgcctctgcacgcgggaggagttcatcagcaaggtgcgctccaacgcggccatcggcgccgtgttccaggaggagcaggggtggaccagcgcctccgaggccgtcaacgacagccggttctgggagctggtggacaaggagcgcgcgctgcaccaggagggcaagtgcgagtcctgcgtgtacaacatgatgggcaagcgcgagaagaagctcggggagttcggccgggccaaggggagccgcgccatctggtacatgtggctgggcgcccggttcctggagttcgaggccctcgggttcctgaacgaggaccactggttcggccgcgagaactcctggagcggcgtcgagggggagggcctgcaccggctcgggtacatcctggaggagatcgacaagaaggacggcgacctgatgtacgcggacgacaccgccggctgggacacccgcatcacggaggacgacctccagaacgaggagctgatcaccgagcagatggccccccaccacaagatcctggccaaggcgatcttcaagctcacctaccagaacaaggtggtgaaggtcctgcggcccaccccgcgcggggccgtgatggacatcatctcccggaaggaccagcgcggcagcgggcaggtgggcacctacgggctgaacacgttcaccaacatggaggtccagctcatccggcagatggaggccgagggcgtgatcacccaggacgacatgcagaaccccaagggcctgaaggagcgcgtggagaagtggctgcgggagtgcggggtcgaccgcctcaagcggatggccatctccggcgacgactgcgtggtgaagcccctggacgagcgcttcgggaccagcctgctcttcctgaacgacatgggcaaggtccggaaggacatcccccagtgggagccgtccaaggggtggaagaactggcaggaggtgcccttctgcagccaccacttccacaagatcttcatgaaggacggccgctccctggtggtcccctgccggaaccaggacgagctcatcggccgcgcccgcatcagccagggggcgggctggtccctgcgggagacggcctgcctggggaaggcctacgcccagatgtggagcctcatgtacttccaccgccgggacctgcgcctggccagcatggcgatctgctccgccgtgcccaccgagtggttcccgaccagccggaccacgtggtccatccacgcccaccaccagtggatgaccaccgaggacatgctcaaggtgtggaaccgcgtctggatcgaggacaaccccaacatgatcgacaagacccccgtgcacagctgggaggacatcccctacctgggcaagcgggaggacctgtggtgcgggtccctcatcggcctgagctcccgcgccacgtgggccaagaacatccacaccgcgatcacccaggtgcggaacctgatcggcaaggaggagtacgtcgactacatgccggtgatgaagcgctacagcgccccctccgagagcgagggggtgctctga

SEQ ID NO: 10461 - RNA, 9867 nt, synthetic construct
  misc_feature 1..9867: note = derived and/or modified CDS sequence (opt1) from DENV-4__FJ639738__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatcagctccacccccctggcggagaacacgaacagcgtgaccaacatcgagctcgagccgcccttcggggactcctacatcgtcatcggcgtgggcaacagcgccctgaccctgcactggttccggaaggggtccagcatcggcaagatgttcgagtccacctaccgcggggccaagcggatggccatcctcggcgagacggcgtgggacttcgggagcgtgggcggcctgttcacctccctggggaaggccgtccaccaggtgttcggcagcgtgtacaccaccatgttcgggggcgtctcctggatgatccgcatcctcatcgggttcctggtgctgtggatcggcacgaacagccggaacacctccatggccatgacctgcatcgccgtgggcgggatcaccctgttcctcggcttcacggtccaggccgacatggggtgcgtggtgagctggtccggccgcgagctgaagtgcgggagcggcatcttcgtcgtggacaacgtgcacacctggaccgagcagtacaagttccagcccgagagccccgcgcggctggcctccgccatcctcaacgcccacaaggacggcgtctgcgggatccgcagcaccacgcggctggagaacgtgatgtggaagcagatcaccaacgagctgaactacgtgctctgggagggcgggcacgacctgaccgtcgtggccggcgacgtgaagggcgtcctgaccaaggggaagcgcgcgctcacgccgcccgtgtccgacctgaagtacagctggaagacctggggcaaggccaagatcttcacccccgaggcccggaactccaccttcctgatcgacgggcccgacacgagcgagtgcccgaacgagcgccgggcctggaactccctcgaggtggaggactacggcttcgggatgttcaccaccaacatctggatgaagttccgcgagggcagctccgaggtctgcgaccaccggctgatgagcgccgcgatcaaggaccagaaggccgtgcacgccgacatgggctactggatcgagtccagcaagaaccagacctggcagatcgagcgcgcctccctgatcgaggtgaagacgtgcctctggcccaagacccacaccctgtggagcaacggggtcctggagtcccagatgctcatccccaagagctacgcgggcccgttctcccagcacaactaccggcaggggtacgccacccagaccgtgggcccctggcacctggggaagctggagatcgacttcggcgagtgccccggcacgaccgtgaccatccaggaggactgcgaccaccgcgggcccagcctccgcaccacgaccgccagcggcaagctggtcacccagtggtgctgccggtcctgcaccatgccgcccctgcgcttcctcggggaggacggctgctggtacgggatggagatccggcccctgagcgagaaggaggagaacatggtgaagtcccaggtcacggccggccagggcaccagcgagaccttctccatggggctgctctgcctgaccctgttcgtggaggagtgcctccgccggcgcgtgacgcggaagcacatgatcctggccgtcgtgatcaccctgtgcgcgatcatcctcggcgggctgacctggatggacctgctccgcgccctgatcatgctgggcgacaccatgagcggccggatcgggggccagacgcacctcgccatcatggccgtgttcaagatgtcccccgggtacgtcctgggcgtgttcctgcgccggctcaccagccgcgagaccgccctgatggtgatcgggatggcgatgaccacgaccctgtccatcccgcacgacctcatggagctgatcgacggcatcagcctgggcctcatcctgctgaagatcgtcacccagttcgacaacacccaggtggggacgctcgccctgtccctgaccttcatccggagcaccatgtccctcgtgatggcctggcgcaccatcatggccgtcctgttcgtggtgacgctgatccccctctgccggaccagctgcctgcagaagcagtcccactgggtcgagatcaccgccctgatcctcggcgcgcaggccctgcccgtgtacctgatgaccctcatgaagggggccagccgccggtcctggcccctgaacgagggcatcatggccgtggggctggtcagcctcctgggctccgcgctgctcaagaacgacgtgccgctggccggccccatggtggccgggggcctgctcctggccgcctacgtcatgagcgggagctccgcggacctgagcctcgagaaggccgccaacgtgcagtgggacgagatggccgacatcacgggctccagccccatcatcgaggtgaagcaggacgaggacgggtccttcagcatccgcgacgtcgaggagaccaacatgatcaccctgctggtgaagctcgccctgatcaccgtgtccggcctgtaccccctcgcgatcccggtcacgatgaccctgtggtacatgtggcaggtgaagacccagcggagcggcgccctgtgggacgtgccctcccccgccgccacccagaaggccgcgctcagcgagggggtctaccgcatcatgcagcggggcctgttcgggaagacccaggtgggcgtggggatccacatggagggcgtcttccacacgatgtggcacgtgacccgcggctccgtgatctgccacgagaccgggcgcctggagcccagctgggccgacgtccggaacgacatgatctcctacggcgggggctggcgcctcggcgacaagtgggacaaggaggaggacgtgcaggtgctggccgtcgagccggggaagaaccccaagcacgtgcagaccaagcccggcctgttcaagacgatcaccggggagatcggcgccgtgaccctcgacttcaagcccgggaccagcggctccccgatcatcaaccggaagggcaaggtcatcgggctgtacggcaacggggtggtgacgaagagcggcgactacgtctccgccatcacccaggcggagcgcatcggggagcccgactacgaggtggacgaggacatcttccggaagaagcgcctgaccatcatggacctccaccccggcgccggcaagaccaagcggatcctgccgagcatcgtgcgcgaggccctgaagcggcgcctgcggacgctcatcctggcccccacccgcgtcgtggcggccgagatggaggaggccctgcgggggctccccatccgctaccagacccccgccgtgaagtccgagcacaccggccgggagatcgtcgacctgatgtgccacgccacgttcaccacccgcctgctcagcagcacccgggtgccgaactacaacctgatcgtcatggacgaggcgcacttcacggacccctccagcgtggccgcccgcgggtacatctccacccgggtggagatgggcgaggccgccgcgatcttcatgaccgccaccccccccggggccacggacccgttcccccagagcaactcccccatcgaggacatcgagcgcgagatccccgagcgcagctggaacaccggcttcgactggatcaccgactaccagggcaagaccgtctggttcgtgccgtccatcaaggccgggaacgacatcgccaactgcctgcggaagagcggcaagaaggtgatccagctctcccgcaagacgttcgacaccgagtaccccaagaccaagctgaccgactgggacttcgtcgtgacgaccgacatcagcgagatgggggcgaacttccgggccggccgcgtgatcgacccccggcgctgcctgaagcccgtcatcctcaccgacgggccggagcgggtgatcctggccggccccatccccgtgacccccgcctccgcggcccagcgccggggccgcatcgggcggaacccggcccaggaggacgaccagtacgtcttcagcggcgaccccctgaagaacgacgaggaccacgcccactggacggaggccaagatgctcctggacaacatctacacccccgaggggatcatccccaccctgttcggcccggagcgcgagaagacccaggcgatcgacggcgagttccggctccgcggggagcagcggaagacgttcgtggagctgatgcgccggggcgacctgcccgtgtggctctcctacaaggtcgccagcgccgggatctcctacaaggaccgcgagtggtgcttcaccggcgagcggaacaaccagatcctggaggagaacatggaggtggagatctggacccgcgagggggagaagaagaagctgcggccccgctggctcgacgcccgcgtgtacgccgaccccatggcgctgaaggacttcaaggagttcgccagcggccggaagtccatcaccctggacatcctcaccgagatcgccagcctgccgacgtacctgtccagccgcgccaagctcgccctggacaacatcgtcatgctgcacaccaccgagcggggcgggcgcgcgtaccagcacgccctcaacgagctgcccgagagcctggagaccctcatgctggtggccctgctcggcgccatgacggcggggatcttcctgttcttcatgcagggcaaggggatcggcaagctgtccatgggcctcatcaccatcgccgtggccagcgggctgctgtgggtcgccgagatccagccccagtggatcgccgcgtccatcatcctcgagttcttcctgatggtgctgctcatcccggagcccgagaagcagcggaccccccaggacaaccagctgatctacgtgatcctgaccatcctcacgatcatcggcctgatcgccgccaacgagatggggctgatcgagaagaccaagaccgacttcggcttctaccaggtcaagaccgagacgaccatcctcgacgtggacctgcgccccgccagcgcctggaccctgtacgcggtggccaccacgatcctcaccccgatgctgcggcacaccatcgagaacacctccgccaacctgagcctcgccgccatcgcgaaccaggccgccgtcctgatggggctgggcaagggctggcccctccaccgcatggacctgggggtgcccctgctcgccatgggctgctactcccaggtgaaccccacgaccctgaccgccagcctggtcatgctcctggtgcactacgcgatcatcgggccgggcctgcaggccaaggccacccgggaggcccagaagcgcacggcggccggcatcatgaagaaccccaccgtggacgggatcaccgtcatcgacctcgagcccatctcctacgaccccaagttcgagaagcagctgggccaggtgatgctgctcgtgctgtgcgccgggcagctgctcctgatgcggaccacgtgggccttctgcgaggtcctgaccctcgccaccggcccgatcctgaccctgtgggaggggaaccccggccgcttctggaacacgaccatcgcggtgagcaccgccaacatcttccggggctcctacctcgccggggccggcctggccttcagcctgatcaagaacgcgcagaccccccgccgggggacgggcaccaccggggagaccctcggcgagaagtggaagcgccagctgaactccctggaccggaaggagttcgaggagtacaagcgcagcggcatcctcgaggtggaccggaccgaggccaagtccgccctgaaggacgggagcaagatcaagcacgccgtctcccgcggcagctccaagatccgctggatcgtggagcgggggatggtgaagcccaagggcaaggtcgtggacctggggtgcggccgcggcgggtggagctactacatggccacgctcaagaacgtgaccgaggtcaagggctacaccaaggggggcccggggcacgaggagcccatccccatggcgacctacggctggaacctggtgaagctgcacagcggcgtggacgtcttctacaagcccacggagcaggtggacaccctcctgtgcgacatcggggagtccagctccaacccgaccatcgaggagggccggaccctgcgcgtgctcaagatggtcgagccctggctgagctccaagcccgagttctgcatcaaggtgctgaacccctacatgccgacggtcatcgaggagctggagaagctccagcggaagcacgggggcaacctggtgcgctgccccctgagccggaactccacccacgagatgtactgggtgagcggcgcctccgggaacatcgtcagctccgtgaacaccaccagcaagatgctcctgaaccgcttcacgacccggcaccgcaagcccacctacgagaaggacgtggacctgggcgccgggacccggtccgtcagcacggagaccgagaagcccgacatgaccatcatcggccgccggctccagcgcctgcaggaggagcacaaggagacctggcactacgaccaggagaacccgtaccggacgtgggcctaccacgggtcctacgaggcgcccagcaccggctccgccagctccatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggccaactggctgtgggccctcctggggaagaagaagaacccccggctgtgcacccgcgaggagttcatcagcaaggtccggagcaacgcggccatcggcgccgtgttccaggaggagcaggggtggacctccgccagcgaggccgtgaacgactcccgcttctgggagctcgtcgacaaggagcgcgcgctgcaccaggagggcaagtgcgagagctgcgtgtacaacatgatgggcaagcgggagaagaagctgggggagttcggccgcgccaaggggtcccgggccatctggtacatgtggctcggcgcccgcttcctggagttcgaggccctggggttcctcaacgaggaccactggttcggccgggagaacagctggtccggcgtggagggggagggcctgcaccgcctggggtacatcctcgaggagatcgacaagaaggacggcgacctgatgtacgcggacgacaccgccggctgggacacgcggatcaccgaggacgacctgcagaacgaggagctcatcaccgagcagatggccccccaccacaagatcctggccaaggcgatcttcaagctgacctaccagaacaaggtcgtgaaggtgctccgccccaccccgcggggggccgtcatggacatcatcagccgcaaggaccagcggggctccgggcaggtgggcacgtacgggctgaacaccttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggccatcagcggcgacgactgcgtcgtgaagcccctcgacgagcggttcgggacgtccctgctgttcctcaacgacatgggcaaggtgcgcaaggacatcccccagtgggagccgagcaaggggtggaagaactggcaggaggtccccttctgctcccaccacttccacaagatcttcatgaaggacggccggagcctggtggtgccctgccgcaaccaggacgagctgatcggccgcgcccggatctcccagggggcgggctggagcctccgcgagaccgcctgcctggggaaggcctacgcccagatgtggtccctgatgtacttccaccggcgcgacctccggctggccagcatggcgatctgcagcgccgtccccaccgagtggttcccgacctcccgcacgacctggagcatccacgcccaccaccagtggatgaccaccgaggacatgctgaaggtgtggaaccgggtgtggatcgaggacaaccccaacatgatcgacaagacgcccgtccactcctgggaggacatcccctacctcggcaagcgcgaggacctgtggtgcgggagcctgatcggcctctccagccgggccacctgggccaagaacatccacaccgcgatcacccaggtgcgcaacctgatcggcaaggaggagtacgtggactacatgccggtcatgaagcggtactccgcccccagcgagtccgagggggtgctgtga

SEQ ID NO: 10462 - RNA, 9867 nt, synthetic construct
  misc_feature 1..9867: note = derived and/or modified CDS sequence (opt1) from DENV-4__FJ639739__SS-prME
  source 1..9867: mol_type = other RNA
agcaccatgaccctgctctgcctgatccccacggccatggccttccacctgtccacccgcgacggcgagccgctcatgatcgtggcgaagcacgagcgggggcgccccctgctgttcaagaccaccgagggcatcaacaagtgcacgctcatcgccatggacctgggggagatgtgcgaggacaccgtcacctacaagtgccccctgctcgtgaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgctcatctccaacatcacgaccgccacccgctgcccgacccagggggagccctacctgaaggaggagcaggaccagcagtacatctgccggcgcgacgtggtggaccggggctgggggaacggctgcggcctgttcgggaagggcggggtcgtgacgtgcgccaagttcagctgctccggcaagatcaccgggaacctcgtgcagatcgagaacctggagtacaccgtcgtggtgaccgtccacaacggcgacacgcacgccgtgggcaacgacaccagcaaccacggggtcaccgccaccatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggaccgcgggcgccgacaccagcgaggtgcactggaactacaaggagcgcatggtgacgttcaaggtcccgcacgccaagcggcaggacgtgaccgtgctggggtcccaggagggcgccatgcacagcgccctggcgggcgccaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatcagctccacccccctggccgagaacacgaacagcgtgaccaacatcgagctcgagccgcccttcggggactcctacatcgtgatcggcgtcggcaacagcgccctgaccctgcactggttccggaaggggtccagcatcggcaagatgttcgagtccacctaccgcggggccaagcggatggcgatcctcggcgagacggcctgggacttcgggagcgtgggcggcctgttcacctccctggggaaggccgtgcaccaggtcttcggcagcgtgtacaccaccatgttcgggggcgtgtcctggatgatccgcatcctcatcgggttcctggtcctgtggatcggcacgaacagccggaacacctccatggccatgacctgcatcgccgtgggcgggatcaccctgttcctcggcttcacggtgcaggcggacatggggtgcgtcgtgagctggtccggccgcgagctgaagtgcgggagcggcatcttcgtggtcgacaacgtgcacacctggaccgagcagtacaagttccagcccgagagccccgcccggctggcctccgccatcctcaacgcccacaaggacggcgtgtgcgggatccgcagcaccacgcggctggagaacgtcatgtggaagcagatcaccaacgagctgaactacgtgctctgggagggcgggcacgacctgaccgtggtcgcgggcgacgtgaagggcgtgctgaccaaggggaagcgcgccctcacgccgcccgtctccgacctgaagtacagctggaagacctggggcaaggccaagatcttcacccccgaggcccggaactccaccttcctgatcgacgggcccgacacgagcgagtgcccgaacgagcgccgggcctggaactccctcgaggtggaggactacggcttcgggatgttcaccaccaacatctggatgaagttccgcgagggcagctccgaggtgtgcgaccaccggctgatgagcgcggccatcaaggaccagaaggccgtccacgccgacatgggctactggatcgagtccagcaagaaccagacctggcagatcgagcgcgcgtccctgatcgaggtgaagacgtgcctctggcccaagacccacaccctgtggagcaacggggtgctggagtcccagatgctcatccccaagagctacgccggcccgttctcccagcacaactaccggcaggggtacgccacccagaccgtcggcccctggcacctggggaagctggagatcgacttcggcgagtgccccggcacgaccgtgaccatccaggaggactgcgaccaccgcgggcccagcctccgcaccacgaccgccagcggcaagctggtgacccagtggtgctgccggtcctgcaccatgccgcccctgcgcttcctcggggaggacggctgctggtacgggatggagatccggcccctgagcgagaaggaggagaacatggtcaagtcccaggtgacggccggccagggcaccagcgagaccttctccatggggctgctctgcctgaccctgttcgtcgaggagtgcctccgccggcgcgtgacgcggaagcacatgatcctggcggtggtcatcaccctgtgcgccatcatcctcggcgggctgacctggatggacctgctccgcgccctgatcatgctgggcgacaccatgagcggccggatcgggggccagacgcacctcgccatcatggccgtgttcaagatgtcccccgggtacgtgctgggcgtcttcctgcgcaagctcaccagccgggagaccgcgctgatggtgatcgggatggccatgaccacgaccctgtccatcccgcacgacctcatggagctgatcgacggcatcagcctgggcctcatcctgctgaagatcgtgacccagttcgacaacacccaggtcgggacgctcgccctgtccctgaccttcatccgcagcaccatgtccctcgtgatggcctggcggaccatcatggccgtgctgttcgtcgtgacgctgatccccctctgccgcaccagctgcctgcagaagcagtcccactgggtggagatcaccgcgctgatcctcggcgcccaggccctgcccgtctacctgatgaccctcatgaagggggccagccggcgctcctggcccctgaacgagggcatcatggcggtggggctggtgagcctcctgggctccgccctgctcaagaacgacgtcccgctggccggccccatggtggccgggggcctgctcctggccgcgtacgtgatgagcgggagctccgccgacctgagcctcgagaaggccgccaacgtccagtgggacgagatggccgacatcacgggctccagccccatcatcgaggtgaagcaggacgaggacgggtccttcagcatccgggacgtggaggagaccaacatgatcaccctgctggtcaagctcgcgctgatcaccgtgtccggcctgtaccccctcgccatcccggtgacgatgaccctgtggtacatgtggcaggtcaagacccagcgcagcggcgccctgtgggacgtgccctcccccgccgccacccagaaggcggccctcagcgagggggtgtaccggatcatgcagcgcggcctgttcgggaagacccaggtcggcgtggggatccacatggagggcgtgttccacacgatgtggcacgtcacccggggctccgtgatctgccacgagaccgggcgcctggagcccagctgggccgacgtgcgcaacgacatgatctcctacggcgggggctggcggctcggcgacaagtgggacaaggaggaggacgtccaggtgctggccatcgagccggggaagaaccccaagcacgtgcagaccaagcccggcctgttcaagacgctcgccggggagatcggcgcggtcaccctggacttcaagcccgggaccagcggctccccgatcatcaaccgcaagggcaaggtgatcgggctgtacggcaacggggtggtcaccaagagcggcgactacgtgtccgccatcacgcaggccgagcggatcggggagcccgactacgaggtggacgaggacatcttccgcaagaagcggctcaccatcatggacctgcaccccggcgccggcaagaccaagcgcatcctgccgagcatcgtccgggaggcgctgaagcgccggctccgcaccctgatcctggcccccacgcgggtggtggccgccgagatggaggaggccctccgcgggctgcccatccggtaccagacccccgcggtcaagtccgagcacaccggccgcgagatcgtggacctgatgtgccacgccaccttcacgacccggctcctgagcagcacccgcgtgccgaactacaacctgatcgtcatggacgaggcccacttcaccgacccctccagcgtggccgcccgggggtacatctccacgcgcgtcgagatgggcgaggcggccgccatcttcatgaccgccaccccccccggggccaccgacccgttcccccagagcaactcccccatcgaggacatcgagcgggagatccccgagcgcagctggaacacgggcttcgactggatcaccgactaccagggcaagaccgtgtggttcgtgccgtccatcaaggcggggaacgacatcgccaactgcctccgcaagagcggcaagaaggtcatccagctgtcccggaagaccttcgacacggagtaccccaagaccaagctgaccgactgggacttcgtggtgaccacggacatcagcgagatgggggccaacttccgcgccggccgggtcatcgacccccgccggtgcctcaagcccgtgatcctgaccgacgggccggagcgcgtgatcctggcgggccccatccccgtcacccccgcctccgccgcccagcggcgcggccggatcgggcgcaacccggcccaggaggacgaccagtacgtgttcagcggcgaccccctcaagaacgacgaggaccacgcgcactggaccgaggccaagatgctgctggacaacatctacacgcccgaggggatcatccccaccctcttcggcccggagcgggagaagacccaggccatcgacggcgagttccgcctgcggggggagcagcgcaagaccttcgtggagctgatgcggcgcggcgacctccccgtctggctgtcctacaaggtggccagcgccgggatctcctacaaggaccgggagtggtgcttcacgggcgagcgcaacaaccagatcctggaggagaacatggaggtggagatctggacccgggagggggagaagaagaagctccgcccccggtggctggacgcgcgcgtctacgccgaccccatggccctgaaggacttcaaggagttcgccagcggccgcaagtccatcaccctcgacatcctgaccgagatcgccagcctgccgacctacctctccagccgggcgaagctggccctggacaacatcgtgatgctccacacgaccgagcgcggcgggcgggcctaccagcacgccctgaacgagctgcccgagagcctcgagaccctgatgctggtggcgctcctgggcgccatgaccgccgggatcttcctgttcttcatgcagggcaaggggatcggcaagctctccatgggcctgatcacgatcgccgtcgccagcgggctgctctgggtggcggagatccagccccagtggatcgccgcctccatcatcctggagttcttcctgatggtgctcctgatcccggagcccgagaagcagcgcaccccccaggacaaccagctgatctacgtcatcctcaccatcctgaccatcatcggcctgatcgccgccaacgagatggggctcatcgagaagacgaagaccgacttcggcttctaccaggtgaagaccgagaccacgatcctggacgtggacctgcggcccgcgagcgcctggaccctctacgccgtcgccaccaccatcctgacgccgatgctgcgccacaccatcgagaacacctccgccaacctcagcctggcggccatcgccaaccaggccgccgtgctgatggggctcggcaagggctggcccctgcaccggatggacctgggggtgcccctcctggcgatgggctgctactcccaggtcaaccccaccacgctgaccgccagcctcgtgatgctgctggtgcactacgccatcatcgggccgggcctccaggccaaggcgacccgcgaggcccagaagcggaccgccgccggcatcatgaagaaccccacggtcgacgggatcaccgtgatcgacctggagcccatctcctacgaccccaagttcgagaagcagctgggccaggtgatgctcctggtcctgtgcgccgggcagctcctgctgatgcgcaccacctgggcgttctgcgaggtgctcacgctggccaccggcccgatcctgaccctctgggaggggaaccccggccggttctggaacaccacgatcgccgtgagcaccgccaacatcttccgcggctcctacctggccggggcgggcctggccttcagcctcatcaagaacgcccagaccccccggcgcgggaccggcacgaccggggagaccctgggcgagaagtggaagcggcagctgaactccctcgaccgcaaggagttcgaggagtacaagcggagcggcatcctggaggtcgaccgcaccgaggccaagtccgccctgaaggacgggagcaagatcaagcacgcggtgtcccggggcagctccaagatccgctggatcgtggagcgcgggatggtcaagcccaagggcaagatcgtggacctcgggtgcggccggggcgggtggagctactacatggccaccctgaagaacgtgacggaggtcaagggctacaccaaggggggcccggggcacgaggagcccatccccatggccacctacggctggaacctggtgaagctccacagcggcgtggacgtcttctacaagcccaccgagcaggtggacacgctgctgtgcgacatcggggagtccagctccaacccgaccatcgaggagggccgcaccctccgggtgctgaagatggtcgagccctggctgagctccaagcccgagttctgcatcaaggtgctgaacccctacatgccgaccgtgatcgaggagctcgagaagctgcagcgcaagcacgggggcaacctggtccggtgccccctcagccgcaactccacgcacgagatgtactgggtgagcggcgcctccgggaacatcgtcagctccgtgaacaccaccagcaagatgctgctgaaccggttcaccacgcgccaccggaagcccacctacgagaaggacgtggacctcggcgcggggacccgctccgtcagcaccgagacggagaagcccgacatgaccatcatcggccggcgcctgcagcggctgcaggaggagcacaaggagacctggcactacgaccaggagaacccgtaccgcacctgggcctaccacgggtcctacgaggcccccagcacgggctccgccagctccatggtgaacggcgtggtcaagctcctgaccaagccctgggacgtgatcccgatggtgacccagctggccatgaccgacacgacccccttcgggcagcagcgggtcttcaaggagaaggtggacacccgcaccccccagcccaagccgggcacgcggatggtgatgaccaccaccgcgaactggctctgggccctgctggggaagaagaagaacccccgcctctgcacgcgggaggagttcatcagcaaggtccgcagcaacgccgccatcggcgccgtgttccaggaggagcaggggtggacctccgcgagcgaggccgtgaacgactcccggttctgggagctggtcgacaaggagcgcgccctgcaccaggagggcaagtgcgagagctgcgtgtacaacatgatgggcaagcgcgagaagaagctcggggagttcggccgggccaaggggtcccgcgccatctggtacatgtggctgggcgcgcggttcctggagttcgaggccctcgggttcctgaacgaggaccactggttcggccgcgagaacagctggtccggcgtggagggggagggcctgcaccggctcgggtacatcctggaggagatcgacaagaaggacggcgacctgatgtacgccgacgacaccgccggctgggacacccgcatcacggaggacgacctccagaacgaggagctgatcaccgagcagatggcgccccaccacaagatcctggccaaggccatcttcaagctcacctaccagaacaaggtcgtgaaggtgctgcggcccaccccgcgcggggccgtcatggacatcatcagccggaaggaccagcgcggctccgggcaggtgggcacctacgggctgaacacgttcaccaacatggaggtgcagctcatccggcagatggaggccgagggcgtcatcacccaggacgacatgcagaaccccaagggcctgaaggagcgcgtggagaagtggctgcgggagtgcggggtggaccgcctcaagcggatggcgatcagcggcgacgactgcgtcgtgaagcccctggacgagcgcttcgggacctccctgctcttcctgaacgacatgggcaaggtgcggaaggacatcccccagtgggagccgagcaaggggtggaagaactggcaggaggtccccttctgctcccaccacttccacaagatcttcatgaaggacggccgcagcctggtggtgccctgccggaaccaggacgagctcatcggccgcgcccgcatctcccagggggccggctggagcctgcgggagacggcctgcctggggaaggcctacgcgcagatgtggtccctcatgtacttccaccgccgggacctgcgcctggccagcatggccatctgcagcgccgtccccaccgagtggctcccgacctcccggaccacgtggagcatccacgcccaccaccagtggatgaccaccgaggacatgctgaaggtgtggaaccgcgtgtggatcgaggacaaccccaacatgatcgacaagacccccgtccactcctgggaggacatcccctacctgggcaagcgggaggacctctggtgcgggagcctgatcggcctgtccagccgcgcgacgtgggccaagaacatccacaccgccatcacccaggtgcggaacctcatcggcaaggaggagtacgtggactacatgccggtcatgaagcgctactccgcccccagcgagtccgagggggtgctgtga

SEQ ID NO: 10463 - RNA, 9867 nt, synthetic construct
  misc_feature 1..9867: note = derived and/or modified CDS sequence (opt1) from DENV-4__JN819409__SS-prME
  source 1..9867: mol_type = other RNA
agcaccatcaccctgctctgcctgatccccaccgtgatggccttccacctgtccacccgcgacggcgagcccctcatgatcgtggccaagcacgagcgggggcggcccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgacggccacctgggtgatgtacgggacctgcacccagagcggggagcggcgccgggagaagcgctccgtggccctgacgccgcacagcggcatgggcctcgagacccgggccgagacctggatgtccagcgagggggcctggaagcacgcgcagcgcgtggagtcctggatcctgcggaaccccggcttcgccctgctcgccgggttcatggcctacatgatcggccagaccgggatccagcgcacggtcttcttcgtgctgatgatgctggtggcgcccagctacggcatgcggtgcgtcggcgtggggaaccgcgacttcgtggagggcgtctccgggggcgcctgggtggacctcgtgctggagcacggcgggtgcgtcaccaccatggcccagggcaagcccaccctggacttcgagctcacgaagaccaccgccaaggaggtggccctgctgcggacctactgcatcgaggcgctcatcagcaacatcacgaccgccacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctcgtccagatcgagaacctggagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctcaccctggactgcgagccccggagcgggatcgacttcaacgagatgatcctgatgaagatgaagaagaagacctggctcgtgcacaagcagtggttcctggacctgcccctcccctggaccgcgggcgccgacacctccgaggtgcactggaactacaaggagcgcatggtcacgttcaaggtgccgcacgccaagcggcaggacgtgaccgtcctggggagccaggagggcgccatgcactccgccctggcgggcgccaccgaggtggacagcggggacggcaaccacatgttcgccgggcacctcaagtgcaaggtgcgcatggagaagctgcgcatcaagggcatgagctacaccatgtgctccggcaagttcagcatcgacaaggagatggccgagacgcagcacgggaccaccgtcgtgaaggtgaagtacgagggcgccggggcgccctgcaaggtccccatcgagatccgggacgtgaacaaggagaaggtggtcggccgcgtgatctccagcacgcccctggccgagaacacgaacggggtgaccaacatcgagctcgagccgcccttcggcgactcctacatcgtcatcggcgtggggaacagcgccctgaccctgcactggttccggaagggctccagcatcgggaagatgttcgagtccacctaccgcggcgccaagcggatggcgatcctcggggagacggcctgggacttcggcagcgtgggcgggctgttcacctccctgggcaaggccgtccaccaggtgttcgggagcgtgtacaccaccatgttcggcggggtctcctggatgatccgcatcctcatcggcttcctggtgctgtggatcggcacgaacagccggaacacctccatggccatgacctgcatcgccgtcggcgggatcaccctgttcctcgggttcacggtccaggcggacatggggtgcgtggtgagctggtccgggcgcgagctgaagtgcggcagcggcatcttcgtcgtggacaacgtgcacacctggaccgagcagtacaagttccagcccgagtcccccgcccggctggccagcgccatcctcaacgcccacaaggacggggtctgcggcatccgcagcaccacgcggctggagaacgtgatgtggaagcagatcaccaacgagctgaactacgtgctctgggagggcggccacgacctgaccgtcgtggcgggcgacgtgaagggggtcctgaccaagggcaagcgcgccctcacgccgcccgtgtccgacctgaagtacagctggaagacctgggggaaggccaagatcttcacccccgaggcccggaactccaccttcctgatcgacggccccgacacgagcgagtgcccgaacgagcgccgggcctggaactccctcgaggtggaggactacgggttcggcatgttcaccaccaacatctggatgaagttccgcgagggcagctccgaggtctgcgaccaccggctgatgagcgcggccatcaaggaccagaaggccgtgcacgccgacatggggtactggatcgagtccagcaagaaccagacctggcagatcgagcgcgcgtccctgatcgaggtgaagacgtgcctctggcccaagacccacaccctgtggagcaacggcgtcctggagtcccagatgctcatccccaagagctacgccgggccgttctcccagcacaactaccggcagggctacgccacccagaccgtggggccctggcacctgggcaagctggagatcgacttcggcgagtgccccgggacgaccgtgaccatccaggaggactgcgaccaccgcggccccagcctccgcaccacgaccgcctccgggaagctggtcacccagtggtgctgccggagctgcaccatgccgcccctgcgcttcctcggcgaggacgggtgctggtacggcatggagatccggcccctgagcgagaaggaggagaacatggtgaagtcccaggtcacggccggccaggggaccagcgagaccttctccatgggcctgctctgcctgaccctgttcgtggaggagtgcctccgccggcgcgtgacgcggaagcacatgatcctggcggtcatcatcaccctgtgcgccatcatcctcgggggcctgacctggatggacctgctccgcgccctgatcatgctgggcgacaccatgagcgggcggatcggcgggcagacgcacctcgccatcatggccgtgttcaagatgtcccccggctacgtgctgggggtcttcctgcgcaagctcaccagccgggagaccgcgctgatggtgatcggcatggccatgaccacgaccctgtccatcccgcacgacctcatggagctgatcgacggcatcagcctggggctcatcctgctgaagatcgtgacccagttcgacaacacccaggtcggcacgctcgccctgtccctgaccttcatccgcagcaccatgtccctcgtgatggcctggcggaccatcatggccgtgctgttcgtcgtgacgctgatccccctctgccgcaccagctgcctgcagaagcagtcccactgggtggagatcaccgcgctgatcctcggggcccaggccctgcccgtctacctgatgaccctcatgaagggcgccagccggcgctcctggcccctgaacgaggggatcatggcggtgggcctggtgagcctcctgggctccgccctgctcaagaacgacgtcccgctggccgggcccatggtggccggcgggctgctcctggccgcgtacgtgatgagcggctccagcgccgacctgagcctcgagaaggccgccaacgtccagtgggacgagatggccgacatcacggggtccagccccatcatcgaggtgaagcaggacgaggacggctccttcagcatccgggacgtggaggagaccaacatgatcaccctgctggtcaagctcgcgctgatcaccgtgtccggcctgtaccccctcgccatcccggtgacgatgaccctgtggtacatgtggcaggtcaagacccagcgcagcggggccctgtgggacgtgccctcccccgccgccacccagaaggcggccctcagcgagggcgtgtaccggatcatgcagcgcgggctgttcggcaagacccaggtcggggtgggcatccacatggagggcgtgttccacacgatgtggcacgtcacccgggggtccgtgatctgccacgagaccggccgcctggagcccagctgggccgacgtgcgcaacgacatgatctcctacgggggcggctggcggctcggggacaagtgggacaaggaggaggacgtccaggtgctggccatcgagccgggcaagaaccccaagcacgtgcagaccaagcccgggctgttcaagacgctcaccggcgagatcggggccgtcaccctggacttcaagcccggcaccagcggctccccgatcatcaaccgcaaggggaaggtgatcggcctgtacgggaacggcgtggtcaccaagagcggggactacgtgtccgcgatcacccaggccgagcggatcggcgagcccgactacgaggtggacgaggacatcttccgcaagaagcggctcaccatcatggacctgcaccccggcgccgggaagaccaagcgcatcctgccgagcatcgtccgggaggccctgaagcgccggctccgcacgctgatcctggcgcccacccgggtggtggccgccgagatggaggaggccctccgcggcctgcccatccggtaccagacccccgccgtcaagtccgagcacaccgggcgcgagatcgtggacctgatgtgccacgcgacgttcaccacccggctcctgagctccacccgcgtgccgaactacaacctgatcgtcatggacgaggcccacttcacggaccccagcagcgtggccgcccggggctacatctccacccgcgtcgagatgggggaggccgcggccatcttcatgaccgccacgccgcccggcgccacggacccgttcccccagagcaactcccccatcgaggacatcgagcgggagatccccgagcgcagctggaacaccggcttcgactggatcaccgactaccaggggaagaccgtgtggttcgtgccgtccatcaaggccggcaacgacatcgcgaactgcctccgcaagagcgggaagaaggtcatccagctgtcccggaagacgttcgacaccgagtaccccaagaccaagctgaccgactgggacttcgtggtgacgaccgacatcagcgagatgggcgccaacttccgcgccgggcgggtcatcgacccccgccggtgcctcaagcccgtgatcctgaccgacggcccggagcgcgtgatcctggccggccccatccccgtcacccccgcgtccgccgcccagcggcgcgggcggatcggccgcaacccggcccaggaggacgaccagtacgtgttcagcggggaccccctcaagaacgacgaggaccacgcccactggacggaggcgaagatgctgctggacaacatctacacccccgagggcatcatccccaccctcttcggcccggagcgggagaagacccaggccatcgacggggagttccgcctgcggggcgagcagcgcaagacgttcgtggagctgatgcggcgcggggacctccccgtctggctgtcctacaaggtggccagcgccggcatctcctacaaggaccgggagtggtgcttcaccggggagcgcaacaaccagatcctggaggagaacatggaggtggagatctggacccgggagggcgagaagaagaagctccgcccccggtggctggacgcccgcgtctacgcggaccccatggccctgaaggacttcaaggagttcgccagcggccgcaagtccatcaccctcgacatcctgaccgagatcgccagcctgccgacgtacctctccagccgggccaagctggcgctggacaacatcgtgatgctccacaccaccgagcgcgggggccgggcctaccagcacgccctgaacgagctgcccgagtccctcgagaccctgatgctggtggccctcctgggggcgatgacggccggcatcttcctgttcttcatgcaggggaagggcatcggcaagctcagcatggggctgatcaccatcgccgtcgccagcggcctgctctgggtggccgagatccagccccagtggatcgcggcctccatcatcctggagttcttcctgatggtgctcctgatcccggagcccgagaagcagcgcacgccccaggacaaccagctgatctacgtcatcctcaccatcctgacgatcatcgggctgatcgccgccaacgagatgggcctcatcgagaagaccaagaccgacttcgggttctaccaggtgaagaccgagacgaccatcctggacgtggacctgcggcccgccagcgcgtggaccctctacgccgtcgccaccacgatcctgaccccgatgctgcgccacaccatcgagaacacctccgccaacctcagcctggccgcgatcgccaaccaggccgccgtgctgatgggcctcggcaaggggtggcccctgcaccggatggacctgggcgtgcccctcctggccatggggtgctactcccaggtcaaccccacgaccctgaccgcgagcctcgtgatgctgctggtgcactacgccatcatcggcccgggcctccaggccaaggccacccgcgaggcgcagaagcggacggccgccgggatcatgaagaaccccaccgtcgacggcatcaccgtgatcgacctggagcccatctcctacgaccccaagttcgagaagcagctgggccaggtgatgctcctggtcctgtgcgccggccagctcctgctgatgcgcaccacgtgggccttctgcgaggtgctcaccctggcgaccgggccgatcctgaccctctgggagggcaaccccggccggttctggaacacgaccatcgccgtgagcaccgccaacatcttccgcgggtcctacctggccggcgccgggctggcgttcagcctcatcaagaacgcccagacgccccggcgcggcacggggaccaccggcgagaccctgggcgagaagtggaagcggcagctgaactccctcgaccgcaaggagttcgaggagtacaagcggagcgggatcctggaggtcgaccgcaccgaggccaagtccgccctgaaggacggcagcaagatcaagcacgccgtgtcccgggggagctccaagatccgctggatcgtggagcgcggcatggtcaagcccaaggggaaggtggtggacctcggctgcggccgcgggggctggagctactacatggcgacgctgaagaacgtcaccgaggtgaaggggtacaccaagggcgggccgggccacgaggagcccatccccatggccacctacggctggaacctggtgaagctccactccggggtcgacgtgttctacaagcccacggagcaggtcgacaccctgctgtgcgacatcggcgagagcagctccaacccgaccatcgaggaggggcgcaccctccgggtcctgaagatggtggagccctggctgagctccaagcccgagttctgcatcaaggtgctgaacccctacatgccgacggtcatcgaggagctcgagaagctgcagcgcaagcacggcggcaacctggtgcggtgccccctcagccgcaactccacccacgagatgtactgggtcagcggggcctccggcaacatcgtgagctccgtgaacaccaccagcaagatgctgctgaaccggttcacgacccgccaccggaagcccacctacgagaaggacgtcgacctcggggccggcacccgctccgtgagcacggagaccgagaagcccgacatgaccatcatcgggcggcgcctgcagcggctgcaggaggagcacaaggagacctggcactacgaccaggagaacccgtaccgcacgtgggcgtaccacggctcctacgaggcccccagcaccggctccgccagctccatggtgaacggggtcgtgaagctcctgaccaagccctgggacgtgatcccgatggtcacccagctggccatgacggacaccacccccttcggccagcagcgggtgttcaaggagaaggtggacacccgcacgccccagcccaagccggggacccggatggtcatgaccaccacggccaactggctctgggcgctgctgggcaagaagaagaacccccgcctctgcaccaaggaggagttcatcagcaaggtgcggtccaacgccgccatcggggccgtgttccaggaggagcagggctggaccagcgccagcgaggcggtcaacgactcccgcttctgggagctggtggacaaggagcgggccctgcaccaggagggcaagtgcgagagctgcgtgtacaacatgatggggaagcgcgagaagaagctcggcgagttcgggcgcgccaagggctcccgggccatctggtacatgtggctgggggcccgcttcctggagttcgaggcgctcggcttcctgaacgaggaccactggttcggccgggagaacagctggtccggggtcgagggcgaggggctgcaccgcctcggctacatcctggaggagatcgacaagaaggacggcgacctgatgtacgccgacgacaccgccgggtgggacacgcggatcaccgaggacgacctccagaacgaggagctgatcaccgagcagatggcgccccaccacaagatcctggcgaaggccatcttcaagctcacctaccagaacaaggtggtgaaggtcctgcgccccaccccgcggggcgccgtgatggacatcatcagccgcaaggaccagcgggggtccggccaggtggggacgtacggcctgaacaccttcaccaacatggaggtccagctcatccgccagatggaggccgagggcgtgatcacccaggacgacatgcagaaccccaaggggctgaaggagcgggtggagaagtggctgcgcgagtgcggcgtcgaccggctcaagcgcatggccatcagcggggacgactgcgtggtgaagcccctggacgagcggttcggcacgtccctcctgttcctgaacgacatggggaaggtccgcaaggacatcccccagtgggagccgagcaagggctggaagaactggcaggaggtgcccttctgctcccaccacttccacaagatcttcatgaaggacggccggagcctggtggtcccctgccgcaaccaggacgagctcatcgggcgggcgcgcatctcccagggcgccgggtggagcctgcgcgagaccgcctgcctgggcaaggcctacgcccagatgtggtccctcatgtacttccaccggcgcgacctgcggctggcgagcatggccatctgctccgccgtgcccaccgagtggttcccgaccagccgcacgacctggagcatccacgcccaccaccagtggatgaccaccgaggacatgctcaaggtgtggaaccgggtctggatcgaggacaaccccaacatgacggacaagacccccatccactcctgggaggacatcccctacctggggaagcgcgaggacctgtggtgcggcagcctcatcggcctgtccagccgggccacctgggcgaagaacatccacaccgccatcacccaggtgcgcaacctgatcgggaaggaggagtacgtggactacatgccggtcatgaagcggtactccgcccccagcgagtccgagggcgtgctctga

SEQ ID NO: 10464 - RNA, 9867 nt, synthetic construct
  misc_feature 1..9867: note = derived and/or modified CDS sequence (opt1) from DENV-4__FJ639742__SS-prME
  source 1..9867: mol_type = other RNA
agcaccatgaccctgctctgcctgatccccacggccatggccttccacctgtccacccgcgacggcgagccgctcatgatcgtggcgaagcacgagcgggggcgccccctgctgttcaagaccaccgagggcatcaacaagtgcacgctcatcgccatggacctgggggagatgtgcgaggacaccgtcacctacaagtgccccctgctcgtgaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatggtgggccagaccgggatccagcgcacggtcttcttcgtgctgatgatgctggtggcgccctcctacggcatgcggtgcgtcggcgtggggaaccgcgacttcgtggagggcgtcagcgggggcgcctgggtggacctcgtgctggagcacggcgggtgcgtcaccaccatggcccagggcaagcccaccctggacttcgagctcacgaagaccaccgccaaggaggtggccctgctgcggacctactgcatcgaggcgctcatctccaacatcacgaccgccacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgcgggcgccgacaccagcgaggtgcactggaactacaaggagcgcatggtcacgttcaaggtgccgcacgccaagcggcaggacgtgaccgtcctggggtcccaggagggcgccatgcacagcgccctggcgggcgccaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggcgccctgcaaggtccccatcgagatccgggacgtgaacaaggagaaggtggtcggccgcgtgatcagctccacccccctggccgagaacacgaacagcgtgaccaacatcgagctcgagccgcccttcggggactcctacatcgtcatcggcgtgggcaacagcgccctgaccctgcactggttccggaaggggtccagcatcggcaagatgttcgagtccacctaccgcggggccaagcggatggcgatcctcggcgagacggcctgggacttcgggagcgtgggcggcctgttcacctccctggggaaggccgtccaccaggtgttcggcagcgtgtacaccaccatgttcgggggcgtctcctggatgatccgcatcctcatcgggttcctggtgctgtggatcggcacgaacagccggaacacctccatggccatgacctgcatcgccgtgggcgggatcaccctgttcctcggcttcacggtccaggcggacatggggtgcgtggtgagctggtccggccgcgagctgaagtgcgggagcggcatcttcgtcgtggacaacgtgcacacctggaccgagcagtacaagttccagcccgagagccccgcccggctggcctccgccatcctcaacgcccacaaggacggcgtctgcgggatccgcagcaccacgcggctggagaacgtgatgtggaagcagatcaccaacgagctgaactacgtgctctgggagggcgggcacgacctgaccgtcgtggcgggcgacgtgaagggcgtcctgaccaaggggaagcgcgccctcacgccgcccgtgtccgacctgaagtacagctggaagacctggggcaaggccaagatcttcacccccgaggcccggaactccaccttcctgatcgacgggcccgacacgagcgagtgcccgaacgagcgccgggcctggaactccctcgaggtggaggactacggcttcgggatgttcaccaccaacatctggatgaagttccgcgagggcagctccgaggtctgcgaccaccggctgatgagcgcggccatcaaggaccagaaggccgtgcacgccgacatgggctactggatcgagtccagcaagaaccagacctggcagatcgagcgcgcgtccctgatcgaggtgaagacgtgcctctggcccaagacccacaccctgtggagcaacggggtcctggagtcccagatgctcatccccaagagctacgccggcccgttctcccagcacaactaccggcaggggtacgccacccagaccgtgggcccctggcacctggggaagctggagatcgacttcggcgagtgccccggcacgaccgtgaccatccaggaggactgcgaccaccgcgggcccagcctccgcaccacgaccgccagcggcaagctggtcacccagtggtgctgccggtcctgcaccatgccgcccctgcgcttcctcggggaggacggctgctggtacgggatggagatccggcccctgagcgagaaggaggagaacatggtgaagtcccaggtcacggccggccagggcaccagcgagaccttctccatggggctgctctgcctgaccctgttcgtggaggagtgcctccgccggcgcgtgacgcggaagcacatgatcctggcggtcgtgatcaccctgtgcgccatcatcctcggcgggctgacctggatggacctgctccgcgccctgatcatgctgggcgacaccatgagcggccggatcgggggccagacgcacctcgccatcatggccgtgttcaagatgtcccccgggtacgtcctgggcgtgttcctgcgcaagctcaccagccgggagaccgcgctgatggtgatcgggatggccatgaccacgaccctgtccatcccgcacgacctcatggagctgatcgacggcatcagcctgggcctcatcctgctgaagatcgtcacccagttcgacaacacccaggtggggacgctcgccctgtccctgaccttcatccgcagcaccatgtccctcgtgatggcctggcggaccatcatggccgtcctgttcgtggtgacgctgatccccctctgccgcaccagctgcctgcagaagcagtcccactgggtcgagatcaccgcgctgatcctcggcgcccaggccctgcccgtgtacctgatgaccctcatgaagggggccagccggcgctcctggcccctgaacgagggcatcatggcggtggggctggtcagcctcctgggctccgccctgctcaagaacgacgtgccgctggccggccccatggtggccgggggcctgctcctggccgcgtacgtcatgagcgggagctccgccgacctgagcctcgagaaggccgcctccgtgcagtgggacgagatggccgacatcacgggcagctcccccatcatcgaggtgaagcaggacgaggacgggagcttctccatccgggacgtcgaggagaccaacatgatcaccctgctggtgaagctcgcgctgatcaccgtgagcggcctgtaccccctcgccatcccggtcacgatgaccctgtggtacatgtggcaggtgaagacccagcgctccggcgccctgtgggacgtgcccagccccgccgccacccagaaggcggccctctccgagggggtctaccggatcatgcagcgcggcctgttcgggaagacccaggtgggcgtggggatccacatggagggcgtcttccacacgatgtggcacgtgacccggggcagcgtgatctgccacgagaccgggcgcctggagccctcctgggccgacgtccgcaacgacatgatcagctacggcgggggctggcggctcggcgacaagtgggacaaggaggaggacgtgcaggtgctggccatcgagccggggaagaaccccaagcacgtccagaccaagcccggcctgttcaagacgctcaccggggagatcggcgccgtgaccctggacttcaagcccgggacctccggcagcccgatcatcaaccgcaagggcaaggtgatcgggctgtacggcaacggggtcgtgacgaagtccggcgactacgtgagcgcgatcacccaggccgagcggatcggggagcccgactacgaggtcgacgaggacatcttccgcaagaagcggctcaccatcatggacctgcaccccggcgccggcaagaccaagcgcatcctgccgtccatcgtgcgggaggccctgaagcgccggctccgcacgctgatcctggcgcccacccgggtggtcgccgccgagatggaggaggccctccgcgggctgcccatccggtaccagacccccgccgtgaagagcgagcacaccggccgcgagatcgtggacctgatgtgccacgcgacgttcaccacccggctcctgagctccacccgcgtcccgaactacaacctgatcgtgatggacgaggcccacttcacggaccccagctccgtcgccgcccgggggtacatcagcacccgcgtggagatgggcgaggccgcggccatcttcatgaccgccaccccccccggggccacggacccgttcccccagtccaacagccccatcgaggacatcgagcgggagatccccgagcgctcctggaacaccggcttcgactggatcaccgactaccagggcaagaccgtgtggttcgtcccgagcatcaaggccgggaacgacatcgcgaactgcctccgcaagtccggcaagaaggtgatccagctgagccggaagacgttcgacaccgagtaccccaagaccaagctgaccgactgggacttcgtggtcacgaccgacatctccgagatgggggccaacttccgcgccggccgggtgatcgacccccgccggtgcctcaagcccgtgatcctgaccgacgggccggagcgcgtcatcctggccggccccatccccgtgacccccgcgagcgccgcccagcggcgcggccggatcgggcgcaacccggcccaggaggacgaccagtacgtgttctccggcgaccccctcaagaacgacgaggaccacgcccactggacggaggcgaagatgctgctggacaacatctacacccccgaggggatcatccccaccctcttcggcccggagcgggagaagacccaggccatcgacggcgagttccgcctgcggggggagcagcgcaagacgttcgtcgagctgatgcggcgcggcgacctccccgtgtggctgagctacaaggtggcctccgccgggatcagctacaaggaccgggagtggtgcttcaccggcgagcgcaacaaccagatcctggaggagaacatggaggtcgagatctggacccgggagggggagaagaagaagctccgcccccggtggctggacgcccgcgtgtacgcggaccccatggccctgaaggacttcaaggagttcgcctccggccgcaagagcatcaccctcgacatcctgaccgagatcgcctccctgccgacgtacctcagcagccgggccaagctggcgctggacaacatcgtgatgctccacaccaccgagcgcggcgggcgggcctaccagcacgccctgaacgagctgcccgagtccctcgagaccctgatgctggtcgccctcctgggcgcgatgacggccgggatcttcctgttcttcatgcagggcaaggggatcggcaagctcagcatgggcctgatcaccatcgccgtggcctccgggctgctctgggtggccgagatccagccccagtggatcgcggccagcatcatcctggagttcttcctgatggtcctcctgatcccggagcccgagaagcagcgcaccccccaggacaaccagctgatctacgtgatcctcaccatcctgacgatcatcggcctgatcgccgccaacgagatggggctcatcgagaagaccaagaccgacttcggcttctaccaggtgaagaccgagacgaccatcctggacgtcgacctgcggcccgcctccgcgtggaccctctacgccgtggccaccacgatcctgaccccgatgctgcgccacaccatcgagaacaccagcgccaacctctccctggccgcgatcgccaaccaggccgccgtgctgatggggctcggcaagggctggcccctgcaccggatggacctgggggtccccctcctggccatgggctgctacagccaggtgaaccccacgaccctgaccgcgtccctcgtgatgctgctggtccactacgccatcatcgggccgggcctccaggccaaggccacccgcgaggcgcagaagcggacggccgccggcatcatgaagaaccccaccgtggacgggatcaccgtgatcgacctggagcccatcagctacgaccccaagttcgagaagcagctgggccaggtcatgctcctggtgctgtgcgccgggcagctcctgctgatgcgcaccacgtgggccttctgcgaggtgctcaccctggcgaccggcccgatcctgaccctctgggaggggaaccccggccggttctggaacacgaccatcgccgtctccaccgccaacatcttccgcggcagctacctggccggggccggcctggcgttctccctcatcaagaacgcccagaccccccggcgcgggacgggcaccaccggggagaccctgggcgagaagtggaagcggcagctgaacagcctcgaccgcaaggagttcgaggagtacaagcggtccggcatcctggaggtggaccgcaccgaggccaagagcgccctgaaggacgggtccaagatcaagcacgccgtgagccggggctccagcaagatccgctggatcgtcgagcgcgggatggtgaagcccaagggcaaggtggtcgacctcgggtgcggccggggcgggtggagctactacatggcgacgctgaagaacgtgaccgaggtgaagggctacaccaaggggggcccggggcacgaggagcccatccccatggccacctacggctggaacctggtcaagctccactccggcgtggacgtgttctacaagcccacggagcaggtcgacaccctgctgtgcgacatcggggagagctccagcaacccgaccatcgaggagggccgcaccctccgggtgctgaagatggtggagccctggctgtccagcaagcccgagttctgcatcaaggtcctgaacccctacatgccgacggtgatcgaggagctcgagaagctgcagcgcaagcacgggggcaacctggtccggtgccccctctcccgcaacagcacccacgagatgtactgggtgtccggcgccagcgggaacatcgtgtccagcgtcaacaccacctccaagatgctgctgaaccggttcacgacccgccaccggaagcccacctacgagaaggacgtggacctcggcgccgggacccgcagcgtgtccacggagaccgagaagcccgacatgaccatcatcggccggcgcctgcagcggctgcaggaggagcacaaggagacctggcactacgaccaggagaacccgtaccgcacgtgggcgtaccacgggagctacgaggccccctccaccggcagcgcctccagcatggtcaacggcgtggtgaagctcctgaccaagccctgggacgtcatcccgatggtgacccagctggccatgacggacaccacccccttcgggcagcagcgggtgttcaaggagaaggtcgacacccgcacgccccagcccaagccgggcacccggatggtgatgaccaccacggccaactggctctgggcgctgctggggaagaagaagaacccccgcctctgcacccgggaggagttcatcagcaaggtgcgctccaacgccgccatcggcgccgtcttccaggaggagcaggggtggaccagcgcctccgaggcggtgaacgacagccggttctgggagctggtggacaaggagcgcgccctgcaccaggagggcaagtgcgagtcctgcgtctacaacatgatgggcaagcgcgagaagaagctcggggagttcggccgggccaaggggagccgcgccatctggtacatgtggctgggcgcccggttcctggagttcgaggcgctcgggttcctgaacgaggaccactggttcggccgcgagaactcctggagcggcgtggagggggagggcctgcaccggctcgggtacatcctggaggagatcgacaagaaggacggcgacctgatgtacgccgacgacaccgccggctgggacacgcgcatcaccgaggacgacctccagaacgaggagctgatcaccgagcagatggccccccaccacaagatcctggcgaaggccatcttcaagctcacctaccagaacaaggtggtcaaggtgctgcggcccaccccgcgcggggccgtgatggacatcatctcccggaaggaccagcgcggcagcgggcaggtcggcacgtacgggctgaacaccttcaccaacatggaggtgcagctcatccggcagatggaggccgagggcgtgatcacccaggacgacatgcagaaccccaagggcctgaaggagcgcgtcgagaagtggctgcgggagtgcggggtggaccgcctcaagcggatggccatctccggcgacgactgcgtggtcaagcccctggacgagcgcttcgggacgagcctgctcttcctgaacgacatgggcaaggtgcggaaggacatcccccagtgggagccgtccaaggggtggaagaactggcaggaggtgcccttctgcagccaccacttccacaagatcttcatgaaggacggccgctccctggtcgtgccctgccggaaccaggacgagctcatcggccgcgcgcgcatcagccagggggccggctggtccctgcgggagaccgcctgcctggggaaggcctacgcccagatgtggagcctcatgtacttccaccgccgggacctgcgcctggcgagcatggccatctgctccgccgtgcccaccgagtggttcccgaccagccggacgacctggtccatccacgcccaccaccagtggatgaccaccgaggacatgctcaaggtctggaaccgcgtgtggatcgaggacaaccccaacatgatcgacaagacgcccgtgcacagctgggaggacatcccctacctgggcaagcgggaggacctgtggtgcgggtccctcatcggcctgagctcccgcgccacctgggcgaagaacatccacaccgccatcacccaggtccggaacctgatcggcaaggaggagtacgtggactacatgccggtgatgaagcgctacagcgccccctccgagagcgagggggtcctctga

SEQ ID NO: 10465 - RNA, 9867 nt, synthetic construct
  misc_feature 1..9867: note = derived and/or modified CDS sequence (opt1) from DENV-4__FJ639745__SS-prME
  source 1..9867: mol_type = other RNA
agcaccatgaccctgctctgcctgatccccacggccatggccttccacctgtccacccgcgacggcgagccgctcatgatcgtggcgaagcacgagcgggggcgccccctgctgttcaagaccaccgagggcatcaacaagtgcacgctcatcgccatggacctgggggagatgtgcgaggacaccgtcacctacaagtgccccctgctcgtgaacaccgagcccgaggacatcgactgctggtgcaacctgacgagcacctgggtgatgtacggcacctgcacccagtccggggagcggcgccgggagaagcgcagcgtcgccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgctcatctccaacatcacgaccgccacccgctgcccgacccagggggagccctacctgaaggaggagcaggaccagcagtacatctgccggcgcgacgtggtggaccggggctgggggaacggctgcggcctgttcgggaagggcggggtcgtgacgtgcgccaagttcagctgctccggcaagatcaccgggaacctcgtgcagatcgagaacctggagtacaccgtcgtggtgaccgtccacaacggcgacacgcacgccgtgggcaacgacaccagcaaccacggggtcaccgccaccatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggaccgcgggcgccgacaccagcgaggtgcactggaactacaaggagcgcatggtgacgttcaaggtcccgcacgccaagcggcaggacgtgaccgtgctggggtcccaggagggcgccatgcacagcgccctggcgggcgccaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatcagctccacccccctggccgagaacacgaacagcgtgaccaacatcgagctcgagccgcccttcggggactcctacatcgtgatcggcgtcggcaacagcgccctgaccctgcactggttccggaaggggtccagcatcggcaagatgttcgagtccacctaccgcggggccaagcggatggcgatcctcggcgagacggcctgggacttcgggagcgtgggcggcctgttcacctccctggggaaggccgtgcaccaggtcttcggcagcgtgtacaccaccatgttcgggggcgtgtcctggatgatccgcatcctcatcgggctgctggtcctgtggatcggcacgaacagccggaacacctccatggccatgacctgcatcgccgtgggcgggatcaccctcttcctgggcttcacggtgcaggcggacatggggtgcgtcgtgagctggtccggccgcgagctgaagtgcgggagcggcatcttcgtggtcgacaacgtgcacacctggaccgagcagtacaagttccagcccgagagccccgcccggctcgcctccgccatcctgaacgcccacaaggacggcgtgtgcgggatccgcagcaccacgcggctggagaacgtcatgtggaagcagatcaccaacgagctcaactacgtgctgtgggagggcgggcacgacctgaccgtggtcgcgggcgacgtgaagggcgtgctcaccaaggggaagcgcgccctgacgccgcccgtctccgacctgaagtacagctggaagacctggggcaaggccaagatcttcacccccgaggcccggaactccaccttcctcatcgacgggcccgacacgagcgagtgcccgaacgagcgccgggcctggaactccctggaggtggaggactacggcttcgggatgttcaccaccaacatctggatgaagttccgcgagggcagctccgaggtgtgcgaccaccggctgatgagcgcggccatcaaggaccagaaggccgtccacgccgacatgggctactggatcgagtccagcaagaaccagacctggcagatcgagcgcgcgtccctcatcgaggtgaagacgtgcctgtggcccaagacccacaccctgtggagcaacggggtgctcgagtcccagatgctgatccccaagagctacgccggcccgttctcccagcacaactaccggcaggggtacgccacccagaccgtcggcccctggcacctggggaagctcgagatcgacttcggcgagtgccccggcacgaccgtgaccatccaggaggactgcgaccaccgcgggcccagcctgcgcaccacgaccgccagcggcaagctggtgacccagtggtgctgccggtcctgcaccatgccgcccctccgcttcctgggggaggacggctgctggtacgggatggagatccggcccctgagcgagaaggaggagaacatggtcaagtcccaggtgacggccggccagggcaccagcgagaccttctccatggggctcctgtgcctgaccctcttcgtcgaggagtgcctgcgccggcgcgtgacgcggaagcacatgatcctggcggtggtcatcaccctctgcgccatcatcctgggcgggctgacctggatggacctcctgcgcgccctgatcatgctcggcgacaccatgagcggccggatcgggggccagacgcacctggccatcatggccgtgttcaagatgtcccccgggtacgtgctgggcgtcttcctccgcaagctgaccagccgggagaccgcgctgatggtgatcgggatggccatgaccacgaccctctccatcccgcacgacctgatggagctgatcgacggcatcagcctcggcctgatcctgctcaagatcgtgacccagttcgacaacacccaggtcgggacgctggccctgtccctcaccttcatccgcagcaccatgtccctggtgatggcctggcggaccatcatggccgtgctgttcgtcgtgacgctcatccccctgtgccgcaccagctgcctgcagaagcagtcccactgggtggagatcaccgcgctcatcctgggcgcccaggccctgcccgtctacctcatgaccctgatgaagggggccagccggcgctcctggcccctgaacgagggcatcatggcggtggggctcgtgagcctgctgggctccgccctcctgaagaacgacgtcccgctggccggccccatggtggccgggggcctcctgctggccgcgtacgtgatgagcgggagctccgccgacctcagcctggagaaggccgccaacgtccagtgggacgagatggccgacatcacgggctccagccccatcatcgaggtgaagcaggacgaggacgggtccttcagcatccgggacgtggaggagaccaacatgatcaccctgctcgtcaagctggcgctgatcaccgtgtccggcctctaccccctggccatcccggtgacgatgaccctgtggtacatgtggcaggtcaagacccagcgcagcggcgccctctgggacgtgccctcccccgccgccacccagaaggcggccctgagcgagggggtgtaccggatcatgcagcgcggcctgttcgggaagacccaggtcggcgtggggatccacatggagggcgtgttccacacgatgtggcacgtcacccggggctccgtgatctgccacgagaccgggcgcctcgagcccagctgggccgacgtgcgcaacgacatgatctcctacggcgggggctggcggctgggcgacaagtgggacaaggaggaggacgtccaggtgctggccatcgagccggggaagaaccccaagcacgtgcagaccaagcccggcctcttcaagacgctgaccggggagatcggcgccgtcaccctggacttcaagcccgggaccagcggctccccgatcatcaaccgcaagggcaaggtgatcgggctctacggcaacggggtggtcacgaagagcggcgactacgtgtccgcgatcacccaggccgagcggatcggggagcccgactacgaggtggacgaggacatcttccgcaagaagcggctgaccatcatggacctgcaccccggcgccggcaagaccaagcgcatcctgccgagcatcgtccgggaggccctcaagcgccggctgcgcacgctgatcctcgcgcccacccgggtggtggccgccgagatggaggaggccctgcgcgggctgcccatccggtaccagacccccgccgtcaagtccgagcacaccggccgcgagatcgtggacctcatgtgccacgcgacgttcaccacccggctgctgagcagcacccgcgtgccgaactacaacctcatcgtcatggacgaggcccacttcacggacccctccagcgtggccgcccgggggtacatctccacccgcgtcgagatgggcgaggccgcggccatcttcatgaccgccaccccccccggggccacggacccgttcccccagagcaactcccccatcgaggacatcgagcgggagatccccgagcgcagctggaacaccggcttcgactggatcaccgactaccagggcaagaccgtgtggttcgtgccgtccatcaaggccgggaacgacatcgcgaactgcctgcgcaagagcggcaagaaggtcatccagctgtcccggaagacgttcgacaccgagtaccccaagaccaagctcaccgactgggacttcgtggtgacgaccgacatcagcgagatgggggccaacttccgcgccggccgggtcatcgacccccgccggtgcctgaagcccgtgatcctgaccgacgggccggagcgcgtgatcctcgccggccccatccccgtcacccccgcgtccgccgcccagcggcgcggccggatcgggcgcaacccggcccaggaggacgaccagtacgtgttcagcggcgaccccctgaagaacgacgaggaccacgcccactggacggaggcgaagatgctgctcgacaacatctacacccccgaggggatcatccccaccctgttcggcccggagcgggagaagacccaggccatcgacggcgagttccgcctgcggggggagcagcgcaagacgttcgtggagctcatgcggcgcggcgacctgcccgtctggctgtcctacaaggtggccagcgccgggatctcctacaaggaccgggagtggtgcttcaccggcgagcgcaacaaccagatcctcgaggagaacatggaggtggagatctggacccgggagggggagaagaagaagctgcgcccccggtggctggacgcccgcgtctacgcggaccccatggccctcaaggacttcaaggagttcgccagcggccgcaagtccatcaccctggacatcctgaccgagatcgccagcctcccgacgtacctgtccagccgggccaagctggcgctcgacaacatcgtgatgctgcacaccaccgagcgcggcgggcgggcctaccagcacgccctgaacgagctccccgagagcctggagaccctgatgctcgtggccctgctgggcgcgatgacggccgggatcttcctcttcttcatgcagggcaaggggatcggcaagctgtccatgggcctgatcaccatcgccgtcgccagcgggctcctgtgggtggccgagatccagccccagtggatcgcggcctccatcatcctggagttcttcctcatggtgctgctgatcccggagcccgagaagcagcgcaccccccaggacaaccagctcatctacgtcatcctgaccatcctgacgatcatcggcctcatcgccgccaacgagatggggctgatcgagaagaccaagaccgacttcggcttctaccaggtgaagaccgagacgaccatcctggacgtggacctccggcccgccagcgcgtggaccctgtacgccgtcgccaccacgatcctgaccccgatgctccgccacaccatcgagaacacctccgccaacctgagcctggccgcgatcgccaaccaggccgccgtgctcatggggctgggcaagggctggcccctgcaccggatggacctcggggtgcccctgctggccatgggctgctactcccaggtcaaccccacgaccctcaccgcgagcctggtgatgctgctcgtgcactacgccatcatcgggccgggcctgcaggccaaggccacccgcgaggcgcagaagcggacggccgccggcatcatgaagaaccccaccgtcgacgggatcaccgtgatcgacctggagcccatctcctacgaccccaagttcgagaagcagctcggccaggtgatgctgctggtcctctgcgccgggcagctgctgctcatgcgcaccacgtgggccttctgcgaggtgctgaccctggcgaccggcccgatcctcaccctgtgggaggggaaccccggccggttctggaacacgaccatcgccgtgagcaccgccaacatcttccgcggctcctacctggccggggccggcctcgcgttcagcctgatcaagaacgcccagaccccccggcgcgggacgggcaccaccggggagaccctgggcgagaagtggaagcggcagctcaactccctggaccgcaaggagttcgaggagtacaagcggagcggcatcctggaggtcgaccgcaccgaggccaagtccgccctcaaggacgggagcaagatcaagcacgccgtgtcccggggcagctccaagatccgctggatcgtggagcgcgggatggtcaagcccaagggcaaggtggtggacctggggtgcggccggggcgggtggagctactacatggcgacgctgaagaacgtcaccgaggtgaagggctacaccaaggggggcccggggcacgaggagcccatccccatggccacctacggctggaacctcgtgaagctgcacagcggcgtcgacgtgttctacaagcccacggagcaggtggacaccctgctctgcgacatcggggagtccagctccaacccgaccatcgaggagggccgcaccctgcgggtcctgaagatggtggagccctggctgagctccaagcccgagttctgcatcaaggtgctcaacccctacatgccgacggtcatcgaggagctggagaagctgcagcgcaagcacgggggcaacctcgtgcggtgccccctgagccgcaactccacccacgagatgtactgggtcagcggcgcctccgggaacatcgtgagctccgtgaacaccaccagcaagatgctgctcaaccggttcacgacccgccaccggaagcccacctacgagaaggacgtcgacctgggcgccgggacccgctccgtgagcacggagaccgagaagcccgacatgaccatcatcggccggcgcctgcagcggctccaggaggagcacaaggagacctggcactacgaccaggagaacccgtaccgcacgtgggcgtaccacgggtcctacgaggcccccagcaccggctccgccagctccatggtgaacggcgtcgtgaagctgctgaccaagccctgggacgtgatcccgatggtcacccagctcgccatgacggacaccacccccttcgggcagcagcgggtgttcaaggagaaggtggacacccgcacgccccagcccaagccgggcacccggatggtcatgaccaccacggccaactggctgtgggcgctgctcgggaagaagaagaacccccgcctgtgcacccgggaggagttcatcagcaaggtgcgcagcaacgccgccatcggcgccgtgttccaggaggagcaggggtggacctccgccagcgaggcggtcaacgactcccggttctgggagctggtggacaaggagcgcgccctccaccaggagggcaagtgcgagagctgcgtgtacaacatgatgggcaagcgcgagaagaagctgggggagttcggccgggccaaggggtcccgcgccatctggtacatgtggctgggcgcccggttcctcgagttcgaggcgctggggttcctgaacgaggaccactggttcggccgcgagaacagctggtccggcgtcgagggggagggcctccaccggctggggtacatcctggaggagatcgacaagaaggacggcgacctcatgtacgccgacgacaccgccggctgggacacgcgcatcaccgaggacgacctgcagaacgaggagctgatcaccgagcagatggccccccaccacaagatcctcgcgaaggccatcttcaagctgacctaccagaacaaggtggtgaaggtcctgcggcccaccccgcgcggggccgtgatggacatcatcagccggaaggaccagcgcggctccgggcaggtgggcacgtacgggctcaacaccttcaccaacatggaggtccagctgatccggcagatggaggccgagggcgtgatcacccaggacgacatgcagaaccccaagggcctgaaggagcgcgtggagaagtggctccgggagtgcggggtcgaccgcctgaagcggatggccatcagcggcgacgactgcgtggtgaagcccctggacgagcgcttcgcgacgtccctcctgttcctgaacgacatggggaaggtccggaaggacatcccccagtgggagccgagcaagggctggaagaactggcaggaggtgcccttctgctcccaccacttccacaagatcttcatgaaggacgggcgcagcctcgtggtcccctgccggaaccaggacgagctgatcggccgcgcccgcatctcccagggcgccgggtggagcctgcgggagaccgcctgcctcggcaaggcctacgcgcagatgtggtccctgatgtacttccaccgccgggacctgcgcctcgccagcatggccatctgcagcgccgtgcccaccgagtggttcccgacctcccggacgacctggagcatccacgcccaccaccagtggatgaccaccgaggacatgctgaaggtgtggaaccgcgtctggatcgaggacaaccccaacatgatcgacaagacgcccgtgcactcctgggaggacatcccctacctggggaagcgggaggacctctggtgcggcagcctgatcgggctgtccagccgcgcgacctgggccaagaacatccacaccgccatcacccaggtgcggaacctcatcggcaaggaggagtacgtcgactacatgccggtgatgaagcgctactccgcccccagcgagtccgagggcgtgctgtga

SEQ ID NO: 10466 - RNA, 9867 nt, synthetic construct
  misc_feature 1..9867: note = derived and/or modified CDS sequence (opt1) from DENV-4__FJ850095__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggaggactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccggtgaccatgaccctctggtacatgtggcaggtcaagacccagcgctccggcgccctgtgggacgtgcccagccccgccgccacccagaaggcggccctgtccgagggggtgtaccggatcatgcagcgcggcctcttcgggaagacgcaggtcggcgtggggatccacatggagggcgtgttccacaccatgtggcacgtcacccggggcagcgtgatctgccacgagaccgggcgcctggagccctcctgggccgacgtgcgcaacgacatgatcagctacggcgggggctggcggctgggcgacaagtgggacaaggaggaggacgtccaggtgctcgccatcgagccggggaagaaccccaagcacgtgcagacgaagcccggcctgttcaagaccctgaccggggagatcggcgccgtcaccctcgacttcaagcccgggacgtccggcagcccgatcatcaaccgcaagggcaaggtgatcgggctgtacggcaacggggtggtcaccaagtccggcgactacgtgagcgcgatcacccaggccgagcggatcggggagcccgactacgaggtggacgaggacatcttccgcaagaagcggctgaccatcatggacctccaccccggcgccggcaagacgaagcgcatcctgccgtccatcgtccgggaggccctgaagcgccggctgcgcaccctcatcctggcgcccacccgggtggtggccgccgagatggaggaggccctgcgcgggctccccatccggtaccagacccccgccgtcaagagcgagcacacgggccgcgagatcgtggacctgatgtgccacgcgaccttcaccacccggctgctctccagcacgcgcgtgccgaactacaacctgatcgtcatggacgaggcccacttcaccgaccccagctccgtggccgcccgggggtacatcagcacccgcgtcgagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtgccgagcatcaaggccgggaacgacatcgcgaactgcctgcgcaagtccggcaagaaggtcatccagctcagccggaagaccttcgacaccgagtaccccaagaccaagctgacggactgggacttcgtggtgaccaccgacatctccgagatgggggccaacttccgcgccggccgggtcatcgacccccgccggtgcctgaagcccgtgatcctcaccgacgggccggagcgcgtgatcctggccggccccatccccgtcacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtctggctcagctacaaggtggcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtctacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtcgcctccgggctgctgtgggtggccgagatccagccccagtggatcgcggccagcatcatcctcgagttcttcctgatggtgctgctcatcccggagcccgagaagcagcggaccccccaggacaaccagctgatctacgtcatcctgacgatcctcaccatcatcggcctgatcgccgccaacgagatggggctgatcgagaagaccaagaccgacttcggcttctaccaggtgaagacggagaccaccatcctcgacgtggacctgcgccccgcctccgcgtggaccctgtacgccgtcgccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtgcccctgctcgccatgggctgctacagccaggtcaaccccaccaccctgaccgcgtccctggtgatgctcctggtgcactacgccatcatcgggccgggcctgcaggccaaggccacgcgggaggcgcagaagcgcaccgccgccggcatcatgaagaaccccaccgtcgacgggatcaccgtgatcgacctcgagcccatcagctacgaccccaagttcgagaagcagctgggccaggtgatgctgctcgtcctgtgcgccgggcagctgctcctgatgcggacgacctgggccttctgcgaggtgctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccaccggggagaccctcggcgagaagtggaagcgccagctgaacagcctggaccggaaggagttcgaggagtacaagcgctccggcatcctcgaggtcgaccggacggaggccaagagcgccctgaaggacgggtccaagatcaagcacgccgtgagccgcggctccagcaagatccggtggatcgtggagcgcgggatggtcaagcccaagggcaaggtggtggacctggggtgcggccgcggcgggtggtcctactacatggcgaccctcaagaacgtcaccgaggtgaagggctacaccaaggggggcccggggcacgaggagcccatccccatggccacgtacggctggaacctggtgaagctgcacagcggcgtcgacgtgttctacaagcccaccgagcaggtggacaccctcctgtgcgacatcggggagagctccagcaacccgaccatcgaggagggccggacgctgcgcgtcctcaagatggtggagccctggctgtccagcaagcccgagttctgcatcaaggtgctgaacccctacatgccgaccgtcatcgaggagctggagaagctccagcggaagcacgggggcaacctggtgcgctgccccctgtcccggaacagcacccacgagatgtactgggtctccggcgccagcgggaacatcgtgtccagcgtgaacaccacgtccaagatgctcctgaaccgcttcaccacccggcaccgcaagcccacctacgagaaggacgtcgacctgggcgccgggacgcggagcgtgtccaccgagaccgagaagcccgacatgaccatcatcggccgccggctccagcgcctgcaggaggagcacaaggagacgtggcactacgaccaggagaacccgtaccggacctgggcgtaccacgggagctacgaggccccctccaccggcagcgcctccagcatggtgaacggcgtcgtgaagctgctcaccaagccctgggacgtgatcccgatggtcacgcagctggccatgaccgacaccacccccttcgggcagcagcgcgtgttcaaggagaaggtggacacgcggaccccccagcccaagccgggcacccgcatggtcatgaccacgaccgccaactggctgtgggcgctcctggggaagaagaagaacccccggctgtgcacccgcgaggagttcatctccaaggtgcggagcaacgccgccatcggcgccgtgttccaggaggagcaggggtggaccagcgcctccgaggcggtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggcgctggggttcctcaacgaggaccactggttcggccgggagaactcctggagcggcgtcgagggggagggcctgcaccgcctggggtacatcctcgaggagatcgacaagaaggacggcgacctgatgtacgccgacgacacggccggctgggacacccggatcaccgaggacgacctgcagaacgaggagctcatcaccgagcagatggccccccaccacaagatcctggcgaaggccatcttcaagctgacctaccagaacaaggtggtgaaggtcctccgccccacgccgcggggggccgtgatggacatcatctcccgcaaggaccagcggggcagcgggcaggtgggcacctacgggctgaacaccttcaccaacatggaggtccagctgatccgccagatggaggccgagggcgtgatcacgcaggacgacatgcagaaccccaagggcctcaaggagcgggtggagaagtggctgcgcgagtgcggggtcgaccggctgaagcgcatggccatctccggcgacgactgcgtggtgaagcccctcgacgagcggttcgggaccagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcgcgcatcagccagggggccggctggtccctccgcgagaccgcctgcctggggaaggcctacgcccagatgtggagcctgatgtacttccaccggcgcgacctccggctggcgtccatggccatctgcagcgccgtgcccaccgagtggttcccgacgagccgcaccacctggtccatccacgcccaccaccagtggatgaccacggaggacatgctgaaggtgtggaaccgggtctggatcgaggacaaccccaacatgatcgacaagacccccgtgcacagctgggaggacatcccctacctcggcaagcgcgaggacctgtggtgcgggtccctgatcggcctcagctcccgggccacctgggcgaagaacatccacaccgccatcacgcaggtgcgcaacctgatcggcaaggaggagtacgtcgactacatgccggtgatgaagcggtacagcgccccctccgagagcgagggggtgctgtga

SEQ ID NO: 10467 - RNA, 9867 nt, synthetic construct
  misc_feature 1..9867: note = derived and/or modified CDS sequence (opt1) from DENV-4__FJ639748__SS-prME
  source 1..9867: mol_type = other RNA
agcaccatgaccctgctctgcctgatccccaccgccatggccttccacctgtccacccgcgacggcgagcccctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgctcatctccaacatcacgaccgccacccgctgcccgacccagggggagccctacctgaaggaggagcaggaccagcagtacatctgccggcgcgacgtggtggaccggggctgggggaacggctgcggcctgttcgggaagggcggggtcgtgacgtgcgccaagttcagctgctccggcaagatcaccgggaacctcgtgcagatcgagaacctggagtacaccgtcgtggtgaccgtccacaacggcgacacgcacgccgtgggcaacgacaccagcaaccacggggtcaccgccaccatcacgccccgctcccccagcgtggaggtgcagctgccggactacggcgagctcaccctggactgcgagccccggtccgggatcgacttcaacgagatgatcctgatgaagatgaagaagaagacctggctcgtccacaagcagtggttcctggacctgcccctcccctggaccgcgggcgccgacaccagcgaggtgcactggaactacaaggagcgcatggtgacgttcaaggtcccgcacgccaagcggcaggacgtgaccgtgctggggtcccaggagggcgccatgcacagcgccctggcgggcgccaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgccggggcgccctgcaaggtgcccatcgagatccgggacgtcaacaaggagaaggtggtgggccgcgtcatcagctccacgcccctggccgagaacacgaacagcgtgaccaacatcgagctcgagccgcccttcggggactcctacatcgtgatcggcgtcggcaacagcgccctgaccctgcactggttccggaaggggtccagcatcggcaagatgttcgagtccacctaccgcggggccaagcggatggcgatcctcggcgagacggcctgggacttcgggagcgtgggcggcctgttcacctccctggggaaggccgtgcaccaggtcttcggcagcgtgtacaccaccatgttcgggggcgtgtcctggatgatccgcatcctcatcgggctgctggtcctgtggatcggcacgaacagccggaacacctccatggccatgacctgcatcgccgtgggcgggatcaccctcttcctgggcttcacggtgcaggcggacgtcgggtgcgtggtgagctggtccggccgcgagctgaagtgcgggagcggcatcttcgtcgtggacaacgtgcacacctggaccgagcagtacaagttccagcccgagagccccgcccggctcgcctccgccatcctgaacgcccacaaggacggcgtctgcgggatccgcagcaccacgcggctggagaacgtgatgtggaagcagatcaccaacgagctcaactacgtgctgtgggagggcgggcacgacctgaccgtcgtggcgggcgacgtgaagggcgtcctcaccaaggggaagcgcgccctgacgccgcccgtgtccgacctgaagtacagctggaagacctggggcaaggccaagatcttcacccccgaggcccggaactccaccttcctcatcgacgggcccgacacgagcgagtgcccgaacgagcgccgggcctggaactccctggaggtggaggactacggcttcgggatgttcaccaccaacatctggatgaagttccgcgagggcagctccgaggtctgcgaccaccggctgatgagcgcggccatcaaggaccagaaggccgtgcacgccgacatgggctactggatcgagtccagcaagaaccagacctggcagatcgagcgcgcgtccctcatcgaggtgaagacgtgcctgtggcccaagacccacaccctgtggagcaacggggtcctcgagtcccagatgctgatccccaagagctacgccggcccgttctcccagcacaactaccggcaggggtacgccacccagaccgtgggcccctggcacctggggaagctcgagatcgacttcggcgagtgccccggcacgaccgtgaccatccaggaggactgcgaccaccgcgggcccagcctgcgcaccacgaccgccagcggcaagctggtcacccagtggtgctgccggtcctgcaccatgccgcccctccgcttcctgggggaggacggctgctggtacgggatggagatccggcccctgagcgagaaggaggagaacatggtgaagtcccaggtcacggccggccagggcaccagcgagaccttctccatggggctcctgtgcctgaccctcttcgtggaggagtgcctgcgccggcgcgtgacgcggaagcacatgatcctggcggtcgtgatcaccctctgcgccatcatcctgggcgggctgacctggatggacctcctgcgcgccctgatcatgctcggcgacaccatgagcggccggatcgggggccagacgcacctggccatcatggccgtgttcaagatgtcccccgggtacgtcctgggcgtgttcctccgcaagctgaccagccgggagaccgcgctgatggtgatcgggatggccatgaccacgaccctctccatcccgcacgacctgatggagctgatcgacggcatcagcctcggcctgatcctgctcaagatcgtcacccagttcgacaacacccaggtggggacgctggccctgtccctcaccttcatccgcagcaccatgtccctggtgatggcctggcggaccatcatggccgtcctgttcgtggtgacgctcatccccctgtgccgcaccagctgcctgcagaagcagtcccactgggtcgagatcaccgcgctcatcctgggcgcccaggccctgcccgtgtacctcatgaccctgatgaagggggccagccggcgctcctggcccctgaacgagggcatcatggcggtggggctcgtcagcctgctgggctccgccctcctgaagaacgacgtgccgctggccggccccatggtggccgggggcctcctgctggccgcgtacgtcatgagcgggagctccgccgacctcagcctggagaaggccgccaacgtgcagtgggacgagatggccgacatcacgggctccagccccatcatcgaggtgaagcaggacgaggacgggtccttcagcatccgggacgtcgaggagaccaacatgatcaccctgctcgtgaagctggcgctgatcaccgtgtccggcctctaccccctggccatcccggtcacgatgaccctgtggtacatgtggcaggtcaagacccagcgcagcggcgccctctgggacgtgccctcccccgccgccacccagaaggcggccctgagcgagggggtctaccggatcatgcagcgcggcctgttcgggaagacccaggtgggcgtggggatccacatggagggcgtcttccacacgatgtggcacgtgacccggggctccgtgatctgccacgagaccgggcgcctcgagcccagctgggccgacgtccgcaacgacatgatctcctacggcgggggctggcggctgggcgacaagtgggacaaggaggaggacgtccaggtgctggccatcgagccggggaagaaccccaagcacgtccagaccaagcccggcctcttcaagacgctgaccggggagatcggcgccgtgaccctggacttcaagcccgggaccagcggctccccgatcatcaaccgcaagggcaaggtgatcgggctctacggcaacggggtcgtgaccaagagcggcgactacgtgtccgcgatcacccaggccgagcggatcggggagcccgactacgaggtcgacgaggacatcttccgcaagaagcggctgaccatcatggacctgcaccccggcgccggcaagaccaagcgcatcctgccgagcatcgtgcgggaggccctcaagcgccggctgcgcacgctgatcctcgcgcccacccgggtggtcgccgccgagatggaggaggccctgcgcgggctgcccatccggtaccagacccccgccgtgaagtccgagcacaccggccgcgagatcgtggacctcatgtgccacgcgacgttcaccacccggctgctgagcagcacccgcgtcccgaactacaacctcatcgtgatggacgaggcccacttcacggacccctccagcgtcgccgcccgggggtacatctccacccgcgtggagatgggcgaggccgcggccatcttcatgaccgccacgccgcccggggccacggacccgttcccccagagcaactcccccatcgaggacatcgagcgggagatccccgagcgcagctggaacaccggcttcgactggatcaccgactaccagggcaagaccgtgtggttcgtcccgtccatcaaggccgggaacgacatcgcgaactgcctgcgcaagagcggcaagaaggtgatccagctgtcccggaagacgttcgacaccgagtaccccaagaccaagctcaccgactgggacttcgtggtcacgaccgacatcagcgagatgggggccaacttccgcgccggccgggtgatcgacccccgccggtgcctgaagcccgtgatcctgaccgacgggccggagcgcgtcatcctcgccggccccatccccgtgacccccgcgtccgccgcccagcggcgcggccggatcgggcgcaacccggcccaggaggacgaccagtacgtgttcagcggcgaccccctgaagaacgacgaggaccacgcccactggacggaggcgaagatgctgctcgacaacatctacacccccgaggggatcatccccaccctgttcggcccggagcgggagaagacccaggccatcgacggcgagttccgcctgcgcggggagcagcgcaagacgttcgtcgagctcatgcggcgcggcgacctgcccgtgtggctgtcctacaaggtggccagcgccgggatctcctacaaggaccgggagtggtgcttcaccggcgagcgcaacaaccagatcctcgaggagaacatggaggtcgagatctggacccgggagggggagaagaagaagctgcgcccccggtggctggacgcccgcgtgtacgcggaccccatggccctcaaggacttcaaggagttcgccagcggccgcaagtccatcaccctggacatcctgaccgagatcgccagcctcccgacgtacctgtccagccgggccaagctggcgctcgacaacatcgtgatgctgcacaccaccgagcgcggcgggcgggcctaccagcacgccctgaacgagctccccgagagcctggagaccctgatgctcgtcgccctgctgggcgcgatgacggccgggatcttcctcttcttcatgcagggcaaggggatcggcaagctgtccatgggcctgatcaccatcgccgtggccagcgggctcctgtgggtggccgagatccagccccagtggatcgcggcctccatcatcctggagttcttcctcatggtcctgctgatcccggagcccgagaagcagcgcacgccccaggacaaccagctcatctacgtgatcctgaccatcctgacgatcatcggcctcatcgccgccaacgagatggggctgatcgagaagaccaagaccgacttcggcttctaccaggtgaagaccgagacgaccatcctggacgtcgacctccggcccgccagcgcgtggaccctgtacgccgtggccaccacgatcctgaccccgatgctccgccacaccatcgagaacacctccgccaacctgagcctggccgcgatcgccaaccaggccgccgtgctcatggggctgggcaagggctggcccctgcaccggatggacctcggggtccccctgctggccatgggctgctactcccaggtgaaccccacgaccctcaccgcgagcctggtgatgctgctcgtccactacgccatcatcgggccgggcctgcaggccaaggccacccgcgaggcgcagaagcggacggccgccggcatcatgaagaaccccaccgtggacgggatcaccgtgatcgacctggagcccatctcctacgaccccaagttcgagaagcagctcggccaggtcatgctgctggtgctctgcgccgggcagctgctgctcatgcgcaccacgtgggccttctgcgaggtgctgaccctggcgaccggcccgatcctcaccctgtgggaggggaaccccggccggttctggaacacgaccatcgccgtcagcaccgccaacatcttccgcggctcctacctggccggggccggcctcgcgttcagcctgatcaagaacgcccagacgccccggcgcgggacgggcaccaccggggagaccctgggcgagaagtggaagcggcagctcaactccctggaccgcaaggagttcgaggagtacaagcggagcggcatcctggaggtggaccgcaccgaggccaagtccgccctcaaggacgggagcaagatcaagcacgccgtgtcccggggcagctccaagatccgctggatcgtcgagcgcgggatggtgaagcccaagggcaaggtggtcgacctggggtgcggccggggcgggtggagctactacatggcgacgctgaagaacgtgaccgaggtgaagggctacaccaagggcggcccggggcacgaggagcccatccccatggccacctacggctggaacctcgtcaagctgcacagcggcgtggacgtgttctacaagcccacggagcaggtcgacaccctgctctgcgacatcggggagtccagctccaacccgaccatcgaggagggccgcaccctgcgggtgctgaagatggtggagccctggctgagctccaagcccgagttctgcatcaaggtcctcaacccctacatgccgacggtgatcgaggagctggagaagctgcagcgcaagcacgggggcaacctcgtccggtgccccctgagccgcaactccacccacgagatgtactgggtgagcggcgcctccgggaacatcgtgagctccgtcaacaccaccagcaagatgctgctcaaccggttcacgacccgccaccggaagcccacctacgagaaggacgtggacctgggcgccgggacccgctccgtgagcacggagaccgagaagcccgacatgaccatcatcggccggcgcctgcagcggctccaggaggagcacaaggagacctggcactacgaccaggagaacccgtaccgcacgtgggcgtaccacgggtcctacgaggcccccagcaccggctccgccagctccatggtcaacggcgtggtgaagctgctgaccaagccctgggacgtcatcccgatggtgacccagctcgccatgacggacaccacccccttcgggcagcagcgggtgttcaaggagaaggtcgacacccgcacgccccagagcaagcccggcacccggatggtgatgaccaccacggccaactggctgtgggcgctgctcgggaagaagaagaacccgcgcctgtgcacccgggaggagttcatcagcaaggtgcgctccaacgccgccatcggcgccgtcttccaggaggagcaggggtggaccagcgcctccgaggcggtgaacgacagccggttctgggagctggtggacaaggagcgcgccctccaccaggagggcaagtgcgagtcctgcgtctacaacatgatgggcaagcgcgagaagaagctgggggagttcggccgggccaaggggagccgcgccatctggtacatgtggctgggcgcccggttcctcgagttcgaggcgctggggttcctgaacgaggaccactggttcggccgcgagaactcctggagcggcgtggagggggagggcctccaccggctggggtacatcctggaggagatcgacaagaaggacggcgacctcatgtacgccgacgacaccgccggctgggacacgcgcatcaccgaggacgacctgcagaacgaggagctgatcaccgagcagatggcgccccaccacaagatcctcgcgaaggccatcttcaagctgacctaccagaacaaggtggtcaaggtgctgcggcccacgccccgcggggccgtgatggacatcatctcccggaaggaccagcggggcagcgggcaggtcggcacgtacgggctcaacaccttcaccaacatggaggtgcagctgatccggcagatggaggccgagggcgtgatcacccaggacgacatgcagaacccgaagggcctgaaggagcgcgtcgagaagtggctccgggagtgcggggtggaccgcctgaagcggatggccatctccggcgacgactgcgtggtcaagcccctggacgagcgcttcgcgacgagcctcctgttcctgaacgacatggggaaggtgcggaaggacatcccccagtgggagccctccaagggctggaagaactggcaggaggtgccgttctgcagccaccacttccacaagatcttcatgaaggacgggcgctccctcgtcgtgccctgccggaaccaggacgagctgatcggccgcgcccgcatcagccagggcgccgggtggtccctgcgggagaccgcctgcctcggcaaggcctacgcgcagatgtggagcctgatgtacttccaccgccgggacctgcgcctcgccagcatggccatctgctccgccgtgcccaccgagtggttccccaccagccggacgacctggtccatccacgcccaccaccagtggatgaccaccgaggacatgctgaaggtctggaaccgcgtgtggatcgaggacaacccgaacatgatcgacaagacgcccgtgcacagctgggaggacatcccctacctggggaagcgggaggacctctggtgcggctccctgatcgggctgagctcccgcgcgacctgggccaagaacatccacaccgccatcacccaggtccggaacctcatcggcaaggaggagtacgtggactacatgcccgtgatgaagcgctacagcgccccgtccgagaacgagggcgtcctgtga

SEQ ID NO: 10468 - RNA, 9867 nt, synthetic construct
  misc_feature 1..9867: note = derived and/or modified CDS sequence (opt1) from DENV-4__FJ639764__SS-prME
  source 1..9867: mol_type = other RNA
agcaccatcaccctgctctgcctgatccccacggtgatggccttccacctgtccacccgcgacggcgagcccctcatgatcgtggccaagcacgagcgggggcgccccctgctgttcaagaccaccgagggcacgaacaagtgcaccctcatcgcgatggacctgggggagatgtgcgaggacaccgtgacctacaagtgccccctgctcgtgaacacggagcccgaggacatcgactgctggtgcaacctgaccagcacctgggtgatgtacgggacctgcacgcagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagacggggatccagcgcaccgtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccacgctggacttcgagctcaccaagaccaccgccaaggaggtggccctgctgcggacgtactgcatcgaggccctcatctccaacatcaccaccgcgacccgctgcccgacgcagggggagccctacctgaaggaggagcaggaccagcagtacatctgccggcgcgacgtggtcgaccggggctgggggaacggctgcggcctgttcgggaagggcggggtggtgacctgcgccaagttcagctgctccggcaagatcaccgggaacctcgtccagatcgagaacctggagtacaccgtggtggtcacggtgcacaacggcgacacccacgccgtcggcaacgacaccagcaaccacggggtgaccgccacgatcacgccccggtcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacacgagcgaggtgcactggaactacaaggagcgcatggtcaccttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagctccacgcccctggcggagaacaccaacagcgtgaccaacatcgagctcgagccgcccttcggggactcctacatcgtcatcggcgtgggcaacagcgccctgaccctgcactggttccggaaggggtccagcatcggcaagatgttcgagtccacgtaccgcggggccaagcggatggccatcctcggcgagaccgcgtgggacttcgggagcgtgggcggcctgttcacctccctggggaaggccgtccaccaggtgttcggcagcgtgtacaccacgatgttcgggggcgtctcctggatgatccgcatcctcatcgggttcctggtgctgtggatcggcaccaacagccggaacacctccatggccatgacctgcatcgccgtgggcgggatcacgctgttcctcggcttcaccgtccaggccgacatggggtgcgtggtgagctggtccggccgcgagctgaagtgcgggagcggcatcttcgtcgtggacaacgtgcacacctggatcgagcagtacaagttccagcccgagagccccgcgcggctggcctccgccatcctcaacgcccacaaggacggcgtctgcgggatccgcagcaccacgcggctggagaacgtgatgtggaagcagatcaccaacgagctgaactacgtgctctgggagggcgggcacgacctgaccgtcgtggccggcgacgtgaagggcgtcctgaccaaggggaagcgcacgctcaccccgcccgtgtccgacctgaagtacagctggaagacctggggcaaggcgaagatcttcacccccgaggcccggaactccacgttcctgatcgacgggcccgacaccagcgagtgcccgaacgagcgccgggcctggaactccctcgaggtggaggactacggcttcgggatgttcaccaccaacatctggatgaagttccgcgagggcagctccgaggtctgcgaccaccggctgatgagcgccgccatcaaggaccagaaggcggtgcacgccgacatgggctactggatcgagtccagcaagaaccagacgtggcagatcgagcgcgcctccctgatcgaggtgaagacctgcctctggcccaagacccacaccctgtggagcaacggggtcctggagtcccagatgctcatccccaagagctacgccggcccgttctcccagcacaactaccggcaggggtacgcgacccagacggtgggcccctggcacctggggaagctggagatcgacttcggcgagtgccccggcaccaccgtgaccatccaggaggactgcgaccaccgcgggcccagcctccgcacgaccaccgccagcggcaagctggtcacccagtggtgctgccggtcctgcacgatgccgcccctgcgcttcctcggggaggacggctgctggtacgggatggagatccggcccctgagcgagaaggaggagaacatggtgaagtcccaggtcaccgccggccagggcaccagcgagaccttctccatggggctgctctgcctgacgctgttcgtggaggagtgcctccgccggcgcgtgacccggaagcacatgatcctggccgtcgtgatcaccctgtgcgccatcatcctcggcgggctgacctggatggacctgctccgcgcgctgatcatgctgggcgacacgatgagcggccggatcgggggccagacccacctcgccatcatggccgtgttcaagatgtcccccgggtacgtcctgggcgtgttcctgcgccggctcaccagccgcgagaccgccctgatggtgatcgggatggccatgacgaccaccctgtccatcccgcacgacctcatggagctgatcgacggcatcagcctgggcctcatcctgctgaagatcgtcacccagttcgacaacacccaggtggggaccctcgcgctgtccctgaccttcatccggagcaccatgtccctcgtgatggcctggcgcacgatcatggccgtcctgttcgtggtgaccctgatccccctctgccggaccagctgcctgcagaagcagtcccactgggtcgagatcaccgccctgatcctcggcgcccaggcgctgcccgtgtacctgatgacgctcatgaagggggccagccgccggtcctggcccctgaacgagggcatcatggccgtggggctggtcagcctcctgggctccgccctgctcaagaacgacgtgccgctggcgggccccatggtggccgggggcctgctcctggccgcctacgtcatgagcgggagctccgccgacctgagcctcgagaaggcggccaacgtgcagtgggacgagatggccgacatcaccggctccagccccatcatcgaggtgaagcaggacgaggacgggtccttcagcatccgcgacgtcgaggagaccaacatgatcaccctgctggtgaagctcgccctgatcacggtgtccggcctgtaccccctcgccatcccggtcaccatgaccctgtggtacatgtggcaggtcaagacccagcggagcggcgcgctgtgggacgtgccctcccccgccgccacccagaaggccgccctcagcgagggggtctaccgcatcatgcagcggggcctgttcgggaagacccaggtgggcgtggggatccacatggagggcgtcttccacaccatgtggcacgtgacccgcggctccgtgatctgccacgagaccgggcgcctggagcccagctgggcggacgtccggaacgacatgatctcctacggcgggggctggcgcctcggcgacaagtgggacaaggaggaggacgtccaggtgctggccgtcgagccggggaagaaccccaagcacgtgcagacgaagcccggcctgttcaagaccatcaccggggagatcggcgccgtgaccctcgacttcaagcccgggacgagcggctccccgatcatcaaccggaagggcaaggtcatcgggctgtacggcaacggggtggtgaccaagagcggcgactacgtctccgccatcacccaggccgagcgcatcggggagcccgactacgaggtggacgaggacatcttccggaagaagcgcctgaccatcatggacctccaccccggcgcgggcaagacgaagcggatcctgccgagcatcgtgcgcgaggccctgaagcggcgcctgcggaccctcatcctggcccccacccgcgtcgtggccgcggagatggaggaggccctgcgggggctccccatccgctaccagacccccgccgtgaagtccgagcacacgggccgggagatcgtcgacctgatgtgccacgccaccttcaccacccgcctgctcagcagcacgcgggtgccgaactacaacctgatcgtcatggacgaggcccacttcaccgacccctccagcgtggcggcccgcgggtacatctccacccgggtggagatgggcgaggccgccgccatcttcatgaccgcgacgccgcccggggccaccgacccgttcccccagagcaactcccccatcgaggacatcgagcgcgagatccccgagcgcagctggaacaccggcttcgactggatcaccgactaccagggcaagacggtctggttcgtgccgtccatcaaggccgggaacgacatcgccaactgcctgcgcaagagcggcaagaaggtgatccagctctcccgcaagaccttcgacaccgagtaccccaagaccaagctgacggactgggacttcgtcgtgaccaccgacatcagcgagatgggggccaacttccgggcgggccgcgtgatcgacccccggcgctgcctgaagcccgtcatcctcaccgacgggccggagcgggtgatcctggccggccccatccccgtgacgcccgcctccgccgcgcagcgccggggccgcatcgggcggaacccggcccaggaggacgaccagtacgtcttcagcggcgaccccctgaagaacgacgaggaccacgcccactggaccgaggccaagatgctcctggacaacatctacacccccgaggggatcatccccaccctgttcggcccggagcgcgagaagacgcaggccatcgacggcgagttccggctccgcggggagcagcggaagaccttcgtggagctgatgcgccggggcgacctgcccgtgtggctctcctacaaggtcgcgagcgccgggatctcctacaaggaccgcgagtggtgcttcaccggcgagcggaacaaccagatcctggaggagaacatggaggtggagatctggacccgcgagggggagaagaagaagctgcggccccgctggctcgacgcccgcgtgtacgccgaccccatggccctgaaggacttcaaggagttcgcgagcggccggaagtccatcaccctggacatcctcacggagatcgccagcctgccgacctacctgtccagccgcgccaagctcgccctggacaacatcgtcatgctgcacaccaccgagcggggcgggcgcgcctaccagcacgcgctcaacgagctgcccgagagcctggagacgctcatgctggtggccctgctcggcgccatgaccgccgggatcttcctgttcttcatgcagggcaaggggatcggcaagctgtccatgggcctcatcaccatcgcggtggccagcgggctgctgtgggtcgccgagatccagccccagtggatcgccgcctccatcatcctcgagttcttcctgatggtgctgctcatcccggagcccgagaagcagcggacgccccaggacaaccagctgatctacgtgatcctgacgatcctcaccatcatcggcctgatcgcggccaacgagatggggctgatcgagaagaccaagaccgacttcggcttctaccaggtcaagacggagaccaccatcctcgacgtggacctgcgccccgccagcgcctggaccctgtacgccgtggcgacgaccatcctcaccccgatgctgcggcacaccatcgagaacacgtccgccaacctgagcctcgccgccatcgccaaccaggcggccgtcctgatggggctgggcaagggctggcccctccaccgcatggacctgggggtgcccctgctcgccatgggctgctactcccaggtgaaccccaccaccctgaccgccagcctggtcatgctcctggtgcactacgccatcatcgggccgggcctgcaggcgaaggccacgcgggaggcccagaagcgcaccgccgcgggcatcatgaagaaccccaccgtggacgggatcaccgtcatcgacctcgagcccatctcctacgaccccaagttcgagaagcagctgggccaggtgatgctgctcgtgctgtgcgccgggcagctgctcctgatgcggacgacctgggccttctgcgaggtcctgaccctcgccaccggcccgatcctgacgctgtgggaggggaaccccggccgcttctggaacaccaccatcgccgtgagcaccgcgaacatcttccggggctcctacctcgccggggccggcctggccttcagcctgatcaagaacgcccagacgccccgccgggggaccggcaccaccggggagaccctcggcgagaagtggaagcgccagctgaactccctggaccggaaggagttcgaggagtacaagcgcagcggcatcctcgaggtggaccggacggaggcgaagtccgccctgaaggacgggagcaagatcaagcacgccgtctcccgcggcagctccaagatccgctggatcgtggagcgggggatggtgaagcccaagggcaaggtcgtggacctggggtgcggccgcggcgggtggagctactacatggccaccctcaagaacgtgaccgaggtcaagggctacaccaagggcgggccggggcacgaggagcccatccccatggccacgtacggctggaacctggtgaagctgcacagcggcgtggacgtcttctacaagcccaccgagcaggtcgacaccctcctgtgcgacatcggggagtccagctccaacccgaccatcgaggagggccggacgctgcgcgtgctcaagatggtcgagccctggctgagctccaagcccgagttctgcatcaaggtgctgaacccctacatgccgaccgtcatcgaggagctggagaagctccagcggaagcacgggggcaacctggtgcgctgccccctgagccggaactccacccacgagatgtactgggtgagcggcgcgtccgggaacatcgtcagctccgtgaacaccacgagcaagatgctcctgaaccgcttcaccacccggcaccgcaagcccacctacgagaaggacgtggacctgggcgccgggacgcggtccgtcagcaccgagaccgagaagcccgacatgaccatcatcggccgccggctccagcgcctgcaggaggagcacaaggagacgtggcactacgaccaggagaacccgtaccggacctgggcctaccacgggtcctacgaggcccccagcaccggctccgcgagctccatggtgaacggcgtggtcaagctgctcaccaagccctgggacgtgatcccgatggtgacgcagctggccatgaccgacaccacccccttcgggcagcagcgcgtcttcaaggagaaggtggacacgcggacgccccagcccaagccgggcacccgcatggtgatgaccacgaccgccaactggctgtgggccctcctggggaagaagaagaacccccggctgtgcacccgcgaggagttcatcagcaaggtccggagcaacgccgcgatcggcgccgtgttccaggaggagcaggggtggacctccgccagcgaggccgtgaacgactcccgcttctgggagctcgtcgacaaggagcgcgccctgcaccaggagggcaagtgcgagagctgcgtgtacaacatgatgggcaagcgggagaagaagctgggggagttcggccgcgcgaaggggtcccgggccatctggtacatgtggctcggcgcccgcttcctggagttcgaggccctggggttcctcaacgaggaccactggttcggccgggagaacagctggtccggcgtggagggggagggcctgcaccgcctggggtacatcctcgaggagatcgacaagaaggacggcgacctgatgtacgccgacgacacggcgggctgggacacccggatcaccgaggacgacctgcagaacgaggagctcatcaccgagcagatggcgccccaccacaagatcctggccaaggccatcttcaagctgacctaccagaacaaggtcgtgaaggtgctccgccccacgccgcgcggggccgtcatggacatcatcagccggaaggaccagcggggctccggccaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggccatcagcggcgacgactgcgtcgtgaagcccctcgacgagcggttcgggacctccctgctgttcctcaacgacatgggcaaggtgcgcaaggacatcccccagtgggagccgagcaaggggtggaagaactggcaggaggtccccttctgctcccaccacttccacaagatcttcatgaaggacggccggagcctggtggtgccctgccgcaaccaggacgagctgatcggccgcgcccggatctcccagggggccggctggagcctccgcgagaccgcgtgcctggggaaggcctacgcccagatgtggtccctgatgtacttccaccggcgcgacctccggctggccagcatggccatctgcagcgcggtccccaccgagtggttcccgacgtcccgcaccacctggagcatccacgcccaccaccagtggatgaccacggaggacatgctgaaggtgtggaaccgggtgtggatcgaggacaaccccaacatgatcgacaagacccccgtccactcctgggaggacatcccctacctcggcaagcgcgaggacctgtggtgcgggagcctgatcggcctctccagccgggccacctgggccaagaacatccacaccgccatcacccaggtgcgcaacctgatcggcaaggaggagtacgtggactacatgccggtcatgaagcggtactccgcgcccagcgagtccgagggggtgctgtga

SEQ ID NO: 10469 - RNA, 9867 nt, synthetic construct
  misc_feature 1..9867: note = derived and/or modified CDS sequence (opt1) from DENV-4__FJ639773__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagcgcctgcggatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgcgacgtgaacaaggagaaggtggtcggccgggtgatcagcgccacgcccctggcggagaacaccaactccgtgaccaacatcgagctcgagccgcccttcggggacagctacatcgtcatcggcgtgggcaactccgccctgaccctgcactggttccgcaaggggagctccatcggcaagatgttcgagagcacgtaccggggggccaagcgcatggccatcctcggcgagaccgcgtgggacttcgggtccgtgggcggcctgttcaccagcctggggaaggccgtccaccaggtgttcggctccgtgtacaccacgatgttcgggggcgtcagctggatgatccggatcctcatcgggttcctggtgctgtggatcggcaccaactcccgcaacaccagcatggccatgacctgcatcgccgtgggcgggatcacgctgttcctcggcttcaccgtccaggccgacatggggtgcgtggtgtcctggagcggccgggagctgaagtgcgggtccggcatcttcgtcgtggacaacgtgcacacctggaccgagcagtacaagttccagcccgagagccccgcgcgcctggccagcgccatcctcaacgcccacaaggacggcgtctgcgggatccggtccacgacccgcctggagaacgtgatgtggaagcagatcaccaacgagctgaactacgtgctctgggagggcgggcacgacctgaccgtcgtggccggcgacgtgaagggcgtcctgacgaaggggaagcgggcgctcaccccgcccgccagcgacctgaagtactcctggaagacctggggcaaggccaagatcttcacccccgaggcccgcaacagcacgttcctgatcgacgggcccgacacctccgagtgcccgaacgagcggcgcgcctggaacagcttcgaggtggaggactacggcttcgggatgttcaccaccaacatctggatgaagttccgggagggctccagcgaggtgtgcgaccaccgcctcatgtccgcggccatcaaggaccagaaggccgtccacgccgacatgggctactggatcgagagctccaagaaccagacgtggcagatcgagcgggcgagcctgatcgaggtgaagacctgcctgtggcccaagacccacaccctctggtccaacggggtgctggagagccagatgctgatccccaagtcctacgccggcccgttcagccagcacaactaccgccaggggtacgccacccagacggtcggcccctggcacctcgggaagctggagatcgacttcggcgagtgccccggcaccaccgtgaccatccaggaggactgcgaccaccgcgggccctccctgcggacgaccaccgccagcggcaagctcgtgacccagtggtgctgccgcagctgcacgatgccgcccctgcggttcctgggggaggacggctgctggtacgggatggagatccgccccctctccgagaaggaggagaacatggtcaagagccaggtgaccgccggccagggcacctccgagaccttcagcatggggctgctgtgcctcacgctgttcgtcgaggagtgcctgcggcgccgggtgacccgcaagcacatgatcctcgcggtggtcatcaccctgtgcgccatcatcctgggcgggctcacctggatggacctgctgcgggccctcatcatgctgggcgacacgatgtccggccgcatcgggggccagacccacctggccatcatggccgtgttcaagatgagccccgggtacgtgctcggcgtcttcctgcggaagctgacctcccgcgagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccggtccaccatgagcctggtgatggcctggcgcacgatcatggccgtgctcttcgtcgtgaccctgatccccctgtgccggacctcctgcctccagaagcagagccactgggtggagatcaccgcgctgatcctgggcgcccaggccctccccgtctacctgatgacgctgatgaagggggcctcccgccggagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgcgacgtggaggagaccaacatgatcaccctcctggtcaagctggcgctcatcacggtgagcggcctgtaccccctggccatcccggtgaccatgaccctctggtacatgtggcaggtcaagacccagcggtccggcgccctgtgggacgtgcccagccccgccaccacgcagaaggccgcgctgtccgagggggtgtaccgcatcatgcagcggggcctcttcgggaagacccaggtcggcgtggggatccacatggagggcgtgttccacaccatgtggcacgtcacccgcggcagcgtgatctgccacgagacggggcgcctggagccctcctgggccgacgtgcggaacgacatgatcagctacggcgggggctggcgcctgggcgacaagtgggacaaggaggaggacgtccaggtgctcgccatcgagccggggaagaaccccaagcacgtgcagaccaagcccggcctgttcaagaccctgaccggggagatcggcgccgtcacgctcgacttcaagcccgggacctccggcagcccgatcatcaaccggaagggcaaggtgatcgggctgtacggcaacggggtggtcaccaagtccggcgactacgtgagcgccatcacccaggcggagcgcatcggggagcccgactacgaggtggacgaggacatcttccggaagaagcgcctgacgatcatggacctccaccccggcgccggcaagaccaagcggatcctgccgtccatcgtccgcgaggccctgaagcggcgcctgcggaccctcatcctggcccccacccgcgtggtggcggccgagatggaggaggccctgcgggggctccccatccgctaccagacgcccgccgtcaagagcgagcacaccggccgggagatcgtggacctgatgtgccacgccaccttcaccacgcgcctgctctccagcacccgggtgccgaactacaacctgatcgtcatggacgaggcgcacttcaccgaccccagctccgtggccgcccgcgggtacatcagcacccgggtcgagatgggcgaggccgccgcgatcttcatgacggccaccccccccggggccaccgacccgttcccccagtccaacagccccatcgaggacatcgagcgcgagatccccgagcgctcctggaacaccggcttcgactggatcacggactaccagggcaagaccgtgtggttcgtgccgagcatcaaggccgggaacgacatcgccaactgcctgcggaagtccggcaagaaggtcatccagctcagccgcaagaccttcgacaccgagtaccccaagacgaagctgaccgactgggacttcgtggtgaccaccgacatctccgagatgggggcgaacttccgggccggccgcgtcatcgacccccggcgctgcctgaagcccgtgatcctcacggacgggccggagcgggtgatcctggccggccccatccccgtcacccccgccagcgcggcccagcgccggggccgcatcgggcggaacccggcccaggaggacgaccagtacgtgttctccggcgaccccctgaagaacgacgaggaccacgcccactggaccgaggccaagatgctcctggacaacatctacacccccgaggggatcatccccacgctgttcggcccggagcgcgagaagacccaggcgatcgacggcgagttccggctccgcggggagcagcggaagaccttcgtggagctgatgcgccggggcgacctgcccgtctggctcagctacaaggtggcctccgccgggatcagctacaaggaccgcgagtggtgcttcaccggcgagcggaacaaccagatcctggaggagaacatggaggtggagatctggacccgcgagggggagaagaagaagctgcggcccaagtggctcgacgcccgcgtctacgccgaccccatggcgctgaaggacttcaaggagttcgcctccggccgcaagagcatcacgctggacatcctcaccgagatcgcctccctgccgacctacctgagctcccgggccaagctcgccctggacaacatcgtgatgctgcacaccacggagcgcggcgggcgggcgtaccagcacgccctcaacgagctgcccgagagcctggagaccctcatgctggtggccctgctcggcgccatgaccgcggggatcttcctgttcttcatgcagggcaaggggatcggcaagctgagcatgggcctcatcaccatcgccgtcgcctccgggctgctgtgggtggccgagatccagccccagtggatcgccgcgagcatcatcctcgagttcttcctgatggtgctgctcatcccggagcccgagaagcagcgcacgccccaggacaaccagctgatctacgtcatcctgaccatcctcaccatcatcggcctgatcgccgccaacgagatggggctgatcgagaagaccaagacggacttcggcttctaccaggagaagaccgagaccaccatcctcgacgtggacctgcggcccgcctccgcctggacgctgtacgcggtggccaccaccatcctcaccccgatgctgcgccacacgatcgagaacaccagcgccaacctgtccctcgccgccatcgcgaaccaggccgccgtcctgatggggctgggcaagggctggcccctccaccggatggacctgggggtgcccctgctcgccatgggctgctacagccaggtgaaccccaccaccctgacggcctccctggtcatgctcctggtgcactacgcgatcatcgggccgggcctgcaggccaaggccacccgcgaggcccagaagcggaccgcggccggcatcatgaagaaccccaccgtggacgggatcacggtcatcgacctcgagcccatcagctacgaccccaagttcgagaagcagctgggccaggtgatgctgctcgtgctgtgcgccgggcagctgctcctgatgcgcaccacctgggccttctgcgaggtcctgaccctcgccacgggcccgatcctgaccctgtgggaggggaaccccggccggttctggaacaccaccatcgcggtgtccacggccaacatcttccgcggcagctacctcgccggggccggcctggccttctccctgatcaagaacgcgcagaccccccggcgcgggaccggcaccaccggggagacgctcggcgagaagtggaagcggcagctgaacagcctggaccgcaaggagttcgaggagtacaagcggtccggcatcctcgaggtggaccgcaccgaggccaagagcgccctgaaggacgggtccaagatcaagcacgccgtcagccggggctccagcaagatccgctggatcgtggagcgcgggatggtgaagcccaagggcaaggtcgtggacctggggtgcggccggggcgggtggtcctactacatggccaccctcaagaacgtgaccgaggtcaagggctacacgaaggggggcccggggcacgaggagcccatccccatggcgacctacggctggaacctggtgaagctgcacagcggcgtggacgtcttctacaagcccaccgagcaggtggacaccctcctgtgcgacatcggggagagctccagcaacccgacgatcgaggagggccgcaccctgcgggtgctcaagatggtcgagccctggctgtccagcaagcccgagttctgcatcaaggtgctgaacccctacatgccgaccgtgatcgaggagctggagaagctccagcgcaagcacgggggcaacctggtccggtgccccctgtcccgcaacagcacccacgagatgtactgggtgtccggcgccagcgggaacatcgtctccagcgtgaacacgacctccaagatgctcctgaaccggttcaccacccgccaccggaagcccacgtacgagaaggacgtggacctgggcgccgggacccgcagcgtctccaccgagaccgagaagcccgacatgacgatcatcggccggcgcctccagcggctgcaggaggagcacaaggagacctggcactacgaccaggagaacccgtaccgcacctgggcctaccacgggagctacgaggcgccctccaccggcagcgcctccagcatggtgaacggcgtggtcaagctgctcacgaagccctgggacgtgatcccgatggtgacccagctggccatgaccgacaccacgcccttcgggcagcagcgggtcttcaaggagaaggtggacacccgcaccccccagcccaagccgggcacccggatggtgatgacgaccaccgccaactggctgtgggccctcctggggaagaagaagaacccccgcctgtgcacccgggaggagttcatctccaaggtccgcagcaacgcggccatcggcgccgtgttccaggaggagcaggggtggacgagcgcctccgaggccgtgaacgacagccggttctgggagctcgtcgacaaggagcgcgcgctgcaccaggagggcaagtgcgagtcctgcgtgtacaacatgatgggcaagcgcgagaagaagctgggggagttcggccgggccaaggggagccgcgccatctggtacatgtggctcggcgcccggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgcggacgacaccgccggctgggacacccgcatcaccgaggacgacctgcagaacgaggagctcatcaccgagcagatggccccccaccacaagatcctggccaaggcgatcttcaagctgacgtaccagaacaaggtcgtgaaggtgctccggcccaccccgcgcggggccgtcatggacatcatctcccggaaggaccagcgcggcagcgggcaggtgggcacctacgggctgaacaccttcacgaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggccatctccggcgacgactgcgtcgtgaagcccctcgacgagcgcttcgggaccagcctgctgttcctcaacgacatgggcaaggtgcggaaggacatcccccagtgggagccgtccaaggggtggaagaactggcaggaggtccccttctgcagccaccacttccacaagatcttcatgaaggacggccgctccctggtggtgccctgccggaaccaggacgagctgatcggccgcgcccgcatcagccagggggcgggctggtccctccgggagaccgcctgcctggggaaggcctacgcccagatgtggagcctgatgtacttccaccgccgggacctccgcctggcctccatggcgatctgcagcgccgtccccacggagtggttcccgaccagccggaccacctggtccatccacgcccaccaccagtggatgacgaccgaggacatgctgaaggtgtggaaccgcgtgtggatcgaggacaaccccaacatgatcgacaagacccccgtccacagctgggaggacatcccctacctcggcaagcgggaggacctgtggtgcgggtccctgatcggcctcagctcccgcgccacctgggccaagaacatccacacggcgatcacccaggtgcggaacctgatcggcaaggaggagtacgtggactacatgccggtcatgaagcgctacagcgccccctccgagagcgagggggtgctgtga

SEQ ID NO: 10470 - RNA, 9867 nt, synthetic construct
  misc_feature 1..9867: note = derived and/or modified CDS sequence (opt1) from DENV-4__FJ882580__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagcgcgtggtcggccgggtgatcagcgccacgcccctggcggagaacaccaactccgtgaccaacatcgagctcgagccgcccttcggggacagctacatcgtcatcggcgtgggcaactccgccctgaccctgcactggttccgcaaggggagctccatcggcaagatgttcgagagcacgtaccggggggccaagcgcatggccatcctcggcgagaccgcgtgggacttcgggtccgtgggcggcctgttcaccagcctggggaaggccgtccaccaggtgttcggctccgtgtacaccacgatgttcgggggcgtcagctggatgatccggatcctcatcgggttcctggtgctgtggatcggcaccaactcccgcaacaccagcatggccatgacctgcatcgccgtgggcgggatcacgctgttcctcggcttcaccgtccaggccgacatggggtgcgtggtgtcctggagcggccgggagctgaagtgcgggtccggcatcttcgtcgtggacaacgtgcacacctggaccgagcagtacaagttccagcccgagagccccgcgcgcctggccagcgccatcctcaacgcccacaaggacggcgtctgcgggatccggtccacgacccgcctggagaacgtgatgtggaagcagatcaccaacgagctgaactacgtgctctgggagggcgggcacgacctgaccatcgtcgccggcgacgtgaagggcgtgctgacgaaggggaagcgggcgctcaccccgcccgccagcgacctgaagtactcctggaagacctggggcaaggccaagatcttcacccccgaggcccgcaacagcacgttcctgatcgacgggcccgacacctccgagtgcccgaacgagcggcgcgcctggaacagcttcgaggtcgaggactacggcttcgggatgttcaccaccaacatctggatgaagttccgggagggctccagcgaggtgtgcgaccaccgcctcatgtccgcggccatcaaggaccagaaggccgtgcacgccgacatgggctactggatcgagagctccaagaaccagacgtggcagatcgagcgggcgagcctgatcgaggtcaagacctgcctgtggcccaagacccacaccctctggtccaacggggtgctggagagccagatgctgatccccaagtcctacgccggcccgttcagccagcacaactaccgccaggggtacgccacccagacggtgggcccctggcacctcgggaagctggagatcgacttcggcgagtgccccggcaccaccgtcaccatccaggagaactgcgaccaccgcgggccctccctgcggacgaccaccgccagcggcaagctcgtgacccagtggtgctgccgcagctgcacgatgccgcccctgcggttcctgggggaggacggctgctggtacgggatggagatccgccccctctccgagaaggaggagaacatggtgaagagccaggtcaccgccggccagggcacctccgagaccttcagcatggggctgctgtgcctcacgctgttcgtggaggagtgcctgcggcgccgggtcacccgcaagcacatgatcctcgcggtggtgatcaccctgtgcgccatcatcctgggcgggctcacctggatggacctgctgcgggccctcatcatgctgggcgacacgatgtccggccgcatcgggggccagacccacctggccatcatggccgtcttcaagatgagccccgggtacgtgctcggcgtgttcctgcggaagctgacctcccgcgagaccgcgctcatggtcatcgggatggccatgacgaccaccctgagcatcccgcacgacctgatggagctcatcgacggcatctccctgggcctgatcctcctgaagatcgtgacccagttcgacaacacgcaggtggggaccctggccctcagcctgaccttcatccggtccaccatgagcctggtcatggcctggcgcacgatcatggccgtgctcttcgtggtcaccctgatccccctgtgccggacctcctgcctccagaagcagagccactgggtggagatcaccgcgctgatcctgggcgcccaggccctccccgtgtacctgatgacgctgatgaagggggcctcccgccggagctggcccctcaacgagggcatcatggcggtcgggctggtgtccctgctcggcagcgccctgctgaagaacgacgtgccgctcgccggccccatggtcgccgggggcctgctgctcgccgcgtacgtgatgtccgggagcagcgccgacctgtccctggagaaggccgccaacgtgcagtgggacgagatggccgacatcaccggcagctcccccatcatcgaggtcaagcaggacgaggacgggagcttctccatccgcgacgtggaggagaccaacatgatcaccctcctggtgaagctggcgctcatcacggtcagcggcctgtaccccctggccatcccgatcaccatgaccctctggtacatgtggcaggtgaagacccagcggtccggcgccctgtgggacgtgcccagccccgccgccacccagaaggcggccctgtccgagggggtctaccgcatcatgcagcggggcctcttcgggaagacgcaggtgggcgtggggatccacatggagggcgtcttccacaccatgtggcacgtgacccgcggcagcgtgatctgccacgagaccgggcgcctggagccctcctgggccgacgtccggaacgacatgatcagctacggcgggggctggcgcctgggcgacaagtgggacaaggaggaggacgtgcaggtgctcgccatcgagccggggaagaaccccaagcacgtccagacgaagcccggcctgttcaagaccctgaccggggagatcggcgccgtgaccctcgacttcaagcccgggacgtccggcagcccgatcatcaaccggaagggcaaggtgatcgggctgtacggcaacggggtcgtgaccaagtccggcgactacgtgagcgcgatcacccaggccgagcgcatcggggagcccgactacgaggtcgacgaggacatcttccggaagaagcgcctgaccatcatggacctccaccccggcgccggcaagacgaagcggatcctgccgtccatcgtgcgcgaggccctgaagcggcgcctgcggaccctcatcctggcgcccacccgcgtggtcgccgccgagatggaggaggccctgcgggggctccccatccgctaccagacccccgccgtgaagagcgagcacacgggccgggagatcgtggacctgatgtgccacgcgaccttcaccacccgcctgctctccagcacgcgggtcccgaactacaacctgatcgtgatggacgaggcccacttcaccgaccccagctccgtggccgcccgcgggtacatcagcacccgggtcgagatgggcgaggccgcggccatcttcatgaccgccacgccccccggggccaccgacccgttcccccagtccaacagccccatcgaggacatcgagcgcgagatccccgagcgctcctggaacaccggcttcgactggatcaccgactaccagggcaagacggtgtggttcgtcccgagcatcaaggccgggaacgacatcgcgaactgcctgcggaagtccggcaagaaggtgatccagctcagccgcaagaccttcgacaccgagtaccccaagaccaagctgacggactgggacttcgtggtcaccaccgacatctccgagatgggggccaacttccgggccggccgcgtgatcgacccccggcgctgcctgaagcccgtgatcctcaccgacgggccggagcgggtcatcctggccggccccatccccgtgacgcccgcgagcgccgcccagcgccggggccgcatcgggcggaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgcgagaagacgcaggccatcgacggcgagttccggctccgcggggagcagcggaagaccttcgtcgagctgatgcgccggggcgacctgcccgtgtggctcagctacaaggtggcctccgccgggatcagctacaaggaccgcgagtggtgcttcaccggcgagcggaacaaccagatcctggaggagaacatggaggtcgagatctggacccgcgagggggagaagaagaagctgcggcccaagtggctcgacgcccgcgtgtacgcggaccccatggccctgaaggacttcaaggagttcgcctccggccgcaagagcatcaccctggacatcctcacggagatcgcctccctgccgacctacctgagctcccgggccaagctcgcgctggacaacatcgtgatgctgcacaccaccgagcgcggcgggcgggcctaccagcacgccctcaacgagctgcccgagagcctggagacgctcatgctggtcgccctgctcggcgcgatgaccgccgggatcttcctgttcttcatgcagggcaaggggatcggcaagctgagcatgggcctcatcaccatcgccgtggcctccgggctgctgtgggtggccgagatccagccccagtggatcgcggccagcatcatcctcgagttcttcctgatggtcctgctcatcccggagcccgagaagcagcgcaccccccaggacaaccagctgatctacgtgatcctgacgatcctcaccatcatcggcctgatcgccgccaacgagatggggctgatcgagaagaccaagaccgacttcggcttctaccaggtgaagacggagaccaccatcctcgacgtcgacctgcggcccgcctccgcgtggaccctgtacgccgtggccacgaccatcctcaccccgatgctgcgccacaccatcgagaacacgagcgccaacctgtccctcgccgcgatcgccaaccaggccgccgtgctgatggggctgggcaagggctggcccctccaccggatggacctgggggtccccctgctcgccatgggctgctacagccaggtgaaccccaccaccctgaccgcgtccctggtgatgctcctggtccactacgccatcatcgggccgggcctgcaggccaaggccacgcgcgaggcgcagaagcggaccgccgccggcatcatgaagaaccccaccgtggacgggatcaccgtgatcgacctcgagcccatcagctacgaccccaagttcgagaagcagctgggccaggtcatgctgctcgtgctgtgcgccgggcagctgctcctgatgcgcacgacctgggccttctgcgaggtgctgaccctcgcgaccggcccgatcctgacgctgtgggaggggaaccccggccggttctggaacaccaccatcgccgtctccaccgccaacatcttccgcggcagctacctcgccggggccggcctggcgttctccctgatcaagaacgcccagacgccccggcgcgggaccggcaccaccggggagaccctcggcgagaagtggaagcggcagctgaacagcctggaccgcaaggagttcgaggagtacaagcggtccggcatcctcgaggtggaccgcacggaggccaagagcgccctgaaggacgggtccaagatcaagcacgccgtgagccggggctccagcaagatccgctggatcgtcgagcgcgggatggtgaagcccaagggcaaggtggtcgacctggggtgcggccggggcgggtggtcctactacatggcgaccctcaagaacgtgaccgaggtgaagggctacaccaaggggggcccggggcacgaggagcccatccccatggccacgtacggctggaacctggtcaagctgcacagcggcgtggacgtgttctacaagcccaccgagcaggtcgacaccctcctgtgcgacatcggggagagctccagcaacccgaccatcgaggagggccgcacgctgcgggtgctcaagatggtggagccctggctgtccagcaagcccgagttctgcatcaaggtcctgaacccctacatgccgaccgtgatcgaggagctggagaagctccagcgcaagcacgggggcaacctggtgcggtgccccctgtcccgcaacagcacccacgagatgtactgggtctccggcgccagcgggaacatcgtgtccagcgtcaacaccacgtccaagatgctcctgaaccggttcaccacccgccaccggaagcccacctacgagaaggacgtggacctgggcgccgggacgcgcagcgtgtccaccgagaccgagaagcccgacatgaccatcatcggccggcgcctccagcggctgcaggaggagcacaaggagacgtggcactacgaccaggagaacccgtaccgcacctgggcgtaccacgggagctacgaggccccctccaccggcagcgcctccagcatggtcaacggcgtggtgaagctgctcaccaagccctgggacgtcatcccgatggtgacgcagctggccatgaccgacaccacccccttcgggcagcagcgggtgttcaaggagaaggtcgacacgcgcaccccccagcccaagccgggcacccggatggtgatgaccacgaccgccaactggctgtgggcgctcctggggaagaagaagaacccccgcctgtgcacccgggaggagttcatctccaaggtgcgcagcaacgccgccatcggcgccgtcttccaggaggagcaggggtggaccagcgcctccgaggcggtgaacgacagccggttctgggagctcgtggacaaggagcgcgccctgcaccaggagggcaagtgcgagtcctgcgtctacaacatgatgggcaagcgcgagaagaagctgggggagttcggccgggccaaggggagccgcgccatctggtacatgtggctcggcgcccggttcctggagttcgaggcgctggggttcctcaacgaggaccactggttcggccgcgagaactcctggagcggcgtggagggggagggcctgcaccggctggggtacatcctcgaggagatcgacaagaaggacggcgacctgatgtacgccgacgacacggccggctgggacacccgcatcaccgaggacgacctgcagaacgaggagctcatcaccgagcagatggccccccaccacaagatcctggcgaaggccatcttcaagctgacctaccagaacaaggtggtcaaggtgctccggcccacgccgcgcggggccgtgatggacatcatctcccggaaggaccagcgcggcagcgggcaggtcggcacctacgggctgaacaccttcaccaacatggaggtgcagctgatccggcagatggaggccgagggcgtgatcacgcaggacgacatgcagaaccccaagggcctcaaggagcgcgtcgagaagtggctgcgggagtgcggggtggaccgcctgaagcggatggccatctccggcgacgactgcgtggtcaagcccctcgacgagcgcttcgggaccagcctgctgttcctcaacgacatgggcaaggtgcggaaggacatcccccagtgggagccgtccaaggggtggaagaactggcaggaggtgcccttctgcagccaccacttccacaagatcttcatgaaggacggccgctccctggtcgtgccctgccggaaccaggacgagctgatcggccgcgcgcgcatcagccagggggccggctggtccctccgggagaccgcctgcctggggaaggcctacgcccagatgtggagcctgatgtacttccaccgccgggacctccgcctggcgtccatggccatctgcagcgccgtgcccaccgagtggttcccgacgagccggaccacctggtccatccacgcccaccaccagtggatgaccacggaggacatgctgaaggtctggaaccgcgtgtggatcgaggacaaccccaacatgatcgacaagacccccgtgcacagctgggaggacatcccctacctcggcaagcgggaggacctgtggtgcgggtccctgatcggcctcagctcccgcgccacctgggcgaagaacatccacaccgccatcacgcaggtccggaacctgatcggcaaggaggagtacgtggactacatgccggtgatgaagcgctacagcgccccctccgagagcgagggggtcctgtga

SEQ ID NO: 10471 - RNA, 9867 nt, synthetic construct
  misc_feature 1..9867: note = derived and/or modified CDS sequence (opt1) from DENV-4__FJ882581__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggaacggccgcgagctgaagtgcgggagcggcatcttcgtcgtggacaacgtgcacacctggaccgagcagtacaagttccagcccgagtcccccgcgcggctggccagcgccatcctcaacgcccacaaggacggcgtctgcgggatccgcagcacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgcctccgacctgaagtacagctggaagacctggggcaaggccaagatcttcacccccgaggcccggaactccacgttcctgatcgacgggcccgacaccagcgagtgcccgaacgagcgccgggcctggaactccttcgaggtggaggactacggcttcgggatgttcaccaccaacatctggatgaagttccgcgagggcagctccgaggtgtgcgaccaccggctcatgagcgcggccatcaaggaccagaaggccgtccacgccgacatgggctactggatcgagtccagcaagaaccagacgtggcagatcgagcgcgcgtccctgatcgaggtgaagacctgcctgtggcccaagacccacaccctctggagcaacggggtgctggagtcccagatgctgatccccaagagctacgccggcccgttctcccagcacaactaccggcaggggtacgccacccagacggtcggcccctggcacctcgggaagctggagatcgacttcggcgagtgccccggcaccaccgtgaccatccaggagaactgcgaccaccgcgggcccagcctgcgcacgaccaccgcctccggcaagctcgtgacccagtggtgctgccggagctgcacgatgccgcccctgcgcttcctgggggaggacggctgctggtacgggatggagatccggcccctcagcgagaaggaggagaacatggtcaagtcccaggtgaccgccggccagggcaccagcgagaccttctccatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgagcggccggatcgggggccagacccacctggccatcatggccgtgttcaagatgtcccccgggtacgtgctcggcgtcttcctgcgcaagctgaccagccgggagaccgcgctcatggtgatcgggatggccatgacgaccaccctgtccatcccgcacgacctgatggagctcatcgacggcatcagcctgggcctgatcctcctgaagatcgtgacccagttcgacaacacgcaggtcgggaccctggccctctccctgaccttcatccgcagcaccatgtccctggtgatggcctggcggacgatcatggccgtgctcttcgtcgtgaccctgatccccctgtgccgcaccagctgcctccagaagcagtcccactgggtggagatcaccgcgctgatcctgggcgcccaggccctccccgtctacctgatgacgctgatgaagggggccagccggcgctcctggcccctcaacgagggcatcatggcggtggggctggtgagcctgctcggctccgccctgctgaagaacgacgtcccgctcgccggccccatggtggccgggggcctgctgctcgccgcgtacgtgatgagcgggtccagcgccgacctgagcctggagaaggccgccaacgtccagtgggacgagatggccgacatcaccggctccagccccatcatcgaggtgaagcaggacgaggacgggtccttcagcatccgggacgtggaggagaccaacatgatcaccctcctggtcaagctggcgctcatcacggtgtccggcctgtaccccctggccatcccgatcaccatgaccctctggtacatgtggcaggtgaagacccagcgcagcggcgccctgtgggacgtcccctcccccgccgccacccagaaggcggccctgagcgagggggtgtaccggatcatgcagcgcggcctcttcgggaagacgcaggtgggcgtcgggatccacatggagggcgtgttccacaccatgtggcacgtgacccggggctccgtcatctgccacgagaccgggcgcctggagcccagctgggccgacgtgcgcaacgacatgatctcctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgagcggctccccgatcatcaaccgcaagggcaaggtcatcgggctgtacggcaacggggtggtgaccaagagcggcgactacgtctccgcgatcacccaggccgagcggatcggggagcccgactacgaggtggacgaggacatcttccgcaagaagcggctgaccatcatggacctccaccccggcgccggcaagacgaagcgcatcctgccgagcatcgtgcgggaggccctgaagcgccggctgcgcaccctcatcctggcgcccacccgggtcgtggccgccgagatggaggaggccctgcgcgggctccccatccggtaccagacccccgccgtgaagtccgagcacacgggccgcgagatcgtcgacctgatgtgccacgcgaccttcaccacccggctgctcagctccacgcgcgtgccgaactacaacctgatcgtgatggacgaggcccacttcaccgaccccagcagcgtcgccgcccgggggtacatctccacccgcgtggagatgggcgaggccgcggccatcttcatgaccgccacgccccccggggccaccgacccgttcccccagagcaactcccccatcgaggacatcgagcgggagatccccgagcgcagctggaacaccggcttcgactggatcaccgactaccagggcaagacggtctggttcgtgccgtccatcaaggccgggaacgacatcgcgaactgcctgcgcaagagcggcaagaaggtgatccagctctcccggaagaccttcgacaccgagtaccccaagaccaagctgacggactgggacttcgtcgtgaccaccgacatcagcgagatgggggccaacttccgcgccggccgggtgatcgacccccgccggtgcctgaagcccgtcatcctcaccgacgggccggagcgcgtgatcctggccggccccatccccgtgacgcccgcgtccgccgcccagcggcgcggccggatcgggcgcaacctggcccaggaggacgaccagtacgtcttcagcggcgacccgctcaagaacgacgaggaccacgcccactggaccgaggcgaagatgctgctggacaacatctacacccccgaggggatcatccccaccctcttcggccccgagcgggagaagacgcaggccatcgacggcgagttccgcctgcggggggagcagcgcaagaccttcgtggagctgatgcggcgcggcgacctcccggtgtggctgtcctacaaggtcgccagcgccgggatctcctacaaggaccgggagtggtgcttcaccggcgagcgcaacaaccagatcctggaggagaacatggaggtggagatctggacccgggagggggagaagaagaagctccgccccaagtggctggacgcccgggtgtacgcggaccccatggccctgaaggacttcaaggagttcgccagcggccgcaagtccatcaccctcgacatcctgacggagatcgccagcctgcccacctacctctccagccgcgccaagctggcgctggacaacatcgtcatgctccacaccaccgagcggggcgggcgcgcctaccagcacgccctgaacgagctgccggagtccctcgagacgctgatgctggtggccctcctgggcgcgatgaccgccgggatcttcctgttcttcatgcagggcaaggggatcggcaagctcagcatgggcctgatcaccatcgccgtggccagcgggctgctctgggtcgccgagatccagccccagtggatcgcggcctccatcatcctggagttcttcctgatggtgctcctgatccccgagccggagaagcagcggaccccccaggacaaccagctgatctacgtgatcctcacgatcctgaccatcatcggcctgatcgccgccaacgagatggggctcatcgagaagaccaagaccgacttcggcttctaccaggtcaagacggagaccaccatcctggacgtggacctgcgccccgccagcgcgtggaccctctacgccgtggccacgaccatcctgacccccatgctgcggcacaccatcgagaacacgtccgccaacctcagcctggccgcgatcgccaaccaggccgccgtcctgatggggctcggcaagggctggccgctgcaccgcatggacctgggggtgcccctcctggccatgggctgctactcccaggtgaaccccaccaccctgaccgcgagcctcgtcatgctgctggtgcactacgccatcatcgggcccggcctccaggccaaggccacgcgggaggcgcagaagcgcaccgccgccggcatcatgaagaacccgaccgtggacgggatcaccgtcatcgacctggagcccatctcctacgaccccaagttcgagaagcagctgggccaggtgatgctcctggtgctgtgcgccgggcagctcctgctgatgcggacgacctgggccttctgcgaggtcctcaccctggcgaccggccccatcctgacgctctgggaggggaacccgggccgcttctggaacaccaccatcgccgtgagcaccgccaacatcttccggggctcctacctggccggggccggcctggcgttcagcctcatcaagaacgcccagacgccccgccgggggaccggcaccaccggggagaccctgggcgagaagtggaagcgccagctgaactccctcgaccggaaggagttcgaggagtacaagcgcagcggcatcctggaggtggaccggacggaggccaagtccgccctgaaggacgggagcaagatcaagcacgccgtctcccgcggcagctccaagatccggtggatcgtggagcgcgggatggtgaagcccaagggcaaggtcgtggacctcgggtgcggccgcggcgggtggagctactacatggcgaccctgaagaacgtgaccgaggtcaagggctacaccaaggggggccccgggcacgaggagccgatccccatggccacgtacggctggaacctggtgaagctccactccggcgtggacgtcttctacaagcccaccgagcaggtggacaccctgctgtgcgacatcggggagagcagctccaaccccaccatcgaggagggccggacgctccgcgtgctgaagatggtcgagccgtggctgagctccaagcccgagttctgcatcaaggtgctgaacccctacatgcccaccgtgatcgaggagctcgagaagctgcagcggaagcacgggggcaacctggtccgctgcccgctcagccggaactccacccacgagatgtactgggtgagcggcgcctccgggaacatcgtcagctccgtgaacaccacgagcaagatgctgctgaaccgcttcaccacccggcaccgcaagcccacctacgagaaggacgtggacctcggcgccgggacgcggtccgtcagcaccgagaccgagaagcccgacatgaccatcatcggccgccggctgcagcgcctgcaggaggagcacaaggagacgtggcactacgaccaggagaacccctaccggacctgggcgtaccacgggtcctacgaggccccgagcaccggctccgccagctccatggtgaacggcgtggtcaagctcctgaccaagccctgggacgtgatccccatggtgacgcagctggccatgaccgacaccaccccgttcgggcagcagcgcgtcttcaaggagaaggtggacacgcggaccccccagcccaagcccggcacccgcatggtgatgaccacgaccgccaactggctctgggcgctgctggggaagaagaagaacccgcggctctgcacccgcgaggagttcatcagcaaggtccggtccaacgccgccatcggcgccgtgttccaggaggagcaggggtggaccagcgccagcgaggcggtgaacgactcccgcttctgggagctggtcgacaaggagcgggccctgcaccaggagggcaagtgcgagagctgcgtgtacaacatgatgggcaagcgcgagaagaagctcggggagttcggccgcgccaaggggtcccgggccatctggtacatgtggctgggcgcccgcttcctggagttcgaggcgctcgggttcctgaacgaggaccactggttcggccgggagaacagctggtccggcgtggagggggagggcctgcaccgcctcgggtacatcctggaggagatcgacaagaaggacggcgacctgatgtacgccgacgacacggccggctgggacacccggatcaccgaggacgacctccagaacgaggagctgatcaccgagcagatggccccccaccacaagatcctggcgaaggccatcttcaagctcacctaccagaacaaggtcgtgaaggtgctgcgccccacgccccggggggccgtcatggacatcatcagccgcaaggaccagcggggctccgggcaggtgggcacctacgggctgaacaccttcaccaacatggaggtgcagctcatccgccagatggaggccgagggcgtcatcacgcaggacgacatgcagaacccgaagggcctgaaggagcgggtggagaagtggctgcgcgagtgcggggtggaccggctcaagcgcatggccatcagcggcgacgactgcgtcgtgaagcccctggacgagcggttcgggacctccctgctcttcctgaacgacatgggcaaggtgcgcaaggacatcccccagtgggagcccagcaaggggtggaagaactggcaggaggtcccgttctgctcccaccacttccacaagatcttcatgaaggacggccggagcctggtggtgccctgccgcaaccaggacgagctcatcggccgggcgcgcatctcccagggggccggctggagcctgcgcgagaccgcctgcctggggaaggcctacgcccagatgtggtccctcatgtacttccaccggcgcgacctgcggctggcgagcatggccatctgctccgccgtccccaccgagtggttccccacgagccgcaccacctggagcatccacgcccaccaccagtggatgaccacggaggacatgctcaaggtgtggaaccgggtgtggatcgaggacaacccgaacatgatcgacaagacccccgtccactcctgggaggacatcccctacctgggcaagcgcgaggacctgtggtgcgggagcctcatcggcctgtccagccgggccacctgggcgaagaacatccacaccgccatcacgcaggtgcgcaacctgatcggcaaggaggagtacgtggactacatgcccgtcatgaagcggtactccgccccgagcgagtccgagggggtgctctga

SEQ ID NO: 10472 - RNA, 9867 nt, synthetic construct
  misc_feature 1..9867: note = derived and/or modified CDS sequence (opt1) from DENV-4__FJ882582__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggaacggccgcgagctgaagtgcgggagcggcatcttcgtcgtggacaacgtgcacacctggaccgagcagtacaagttccagcccgagtcccccgcgcggctggccagcgccatcctcaacgcccacaaggacggcgtctgcgggatccgcagcacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgcctccgacctgaagtacagctggaagacctggggcaaggccaagatcttcacccccgaggcccggaactccacgttcctgatcgacgggcccgacaccagcgagtgcccgaacgagcgccgggcctggaactccttcgaggtggaggactacggcttcgggatgttcaccaccaacatctggatgaagttccgcgagggcagctccgaggtgtgcgaccaccggctcatgagcgcggccatcaaggaccagaaggccgtccacgccgacatgggctactggatcgagtccagcaagaaccagacgtggcagatcgagcgcgcgtccctgatcgaggtgaagacctgcctgtggcccaagacccacaccctctggagcaacggggtgctggagtcccagatgctgatccccaagagctacgccggcccgttctcccagcacaactaccggcaggggtacgccacccagacggtcggcccctggcacctcgggaagctggagatcgacttcggcgagtgccccggcaccaccgtgaccatccaggagaactgcgaccaccgcgggcccagcctgcgcacgaccaccgcctccggcaagctcgtgacccagtggtgctgccggagctgcacgatgccgcccctgcgcttcctgggggaggacggctgctggtacgggatggagatccggcccctcagcgagaaggaggagaacatggtcaagtcccaggtgaccgccggccagggcaccagcgagaccttctccatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgagcggccggatcgggggccagacccacctggccatcatggccgtgttcaagatgtcccccgggtacgtgctcggcgtcttcctgcgcaagctgaccagccgggagaccgcgctcatggtgatcgggatggccatgacgaccaccctgtccatcccgcacgacctgatggagctcatcgacggcatcagcctgggcctgatcctcctgaagatcgtgacccagttcgacaacacgcaggtcgggaccctggccctctccctgaccttcatccgcagcaccatgtccctggtgatggcctggcggacgatcatggccgtgctcttcgtcgtgaccctgatccccctgtgccgcaccagctgcctccagaagcagtcccactgggtggagatcaccgcgctgatcctgggcgcccaggccctccccgtctacctgatgacgctgatgaagggggccagccggcgctcctggcccctcaacgagggcatcatggcggtggggctggtgagcctgctcggctccgccctgctgaagaacgacgtcccgctcgccggccccatggtggccgggggcctgctgctcgccgcgtacgtgatgagcgggtccagcgccgacctgagcctggagaaggccgccaacgtccagtgggacgagatggccgacatcaccggctccagccccatcatcgaggtgaagcaggacgaggacgggtccttcagcatccgggacgtggaggagaccaacatgatcaccctcctggtcaagctggcgctcatcacggtgtccggcctgtaccccctggccatcccgatcaccatgaccctctggtacatgtggcaggtgaagacccagcgcagcggcgccctgtgggacgtcccctcccccgccgccacccagaaggcggccctgagcgagggggtgtaccggatcatgcagcgcggcctcttcgggaagacgcaggtgggcgtcgggatccacatggagggcgtgttccacaccatgtggcacgtgacccggggctccgtcatctgccacgagaccgggcgcctggagcccagctgggccgacgtgcgcaacgacatgatctcctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgagcggctccccgatcatcaaccgcaagggcaaggtcatcgggctgtacggcaacggggtggtgaccaagagcggcgactacgtctccgcgatcacccaggccgagcggatcggggagcccgactacgaggtggacgaggacatcttccgcaagaagcggctgaccatcatggacctccaccccggcgccggcaagacgaagcgcatcctgccgagcatcgtgcgggaggccctgaagcgccggctgcgcaccctcatcctggcgcccacccgggtcgtggccgccgagatggaggaggccctgcgcgggctccccatccggtaccagacccccgccgtgaagtccgagcacacgggccgcgagatcgtcgacctgatgtgccacgcgaccttcaccacccggctgctcagctccacgcgcgtgccgaactacaacctgatcgtgatggacgaggcccacttcaccgaccccagcagcgtcgccgcccgggggtacatctccacccgcgtggagatgggcgaggccgcggccatcttcatgaccgccacgccccccggggccaccgacccgttcccccagagcaactcccccatcgaggacatcgagcgggagatccccgagcgcagctggaacaccggcttcgactggatcaccgactaccagggcaagacggtctggttcgtgccgtccatcaaggccgggaacgacatcgcgaactgcctgcgcaagagcggcaagaaggtgatccagctctcccggaagaccttcgacaccgagtaccccaagaccaagctgacggactgggacttcgtcgtgaccaccgacatcagcgagatgggggccaacttccgcgccggccgggtgatcgacccccgccggtgcctgaagcccgtcatcctcaccgacgggccggagcgcgtgatcctggccggccccatccccgtgacgcccgcgtccgccgcccagcggcgcggccggatcgggcgcaacctggcccaggaggacgaccagtacgtcttcagcggcgacccgctcaagaacgacgaggaccacgcccactggaccgaggcgaagatgctgctggacaacatctacacccccgaggggatcatccccaccctcttcggccccgagcgggagaagacgcaggccatcgacggcgagttccgcctgcggggggagcagcgcaagaccttcgtggagctgatgcggcgcggcgacctcccggtgtggctgtcctacaaggtcgccagcgccgggatctcctacaaggaccgggagtggtgcttcaccggcgagcgcaacaaccagatcctggaggagaacatggaggtggagatctggacccgggagggggagaagaagaagctccgccccaagtggctggacgcccgggtgtacgcggaccccatggccctgaaggacttcaaggagttcgccagcggccgcaagtccatcaccctcgacatcctgacggagatcgccagcctgcccacctacctctccagccgcgccaagctggcgctggacaacatcgtcatgctccacaccaccgagcggggcgggcgcgcctaccagcacgccctgaacgagctgccggagtccctcgagacgctgatgctggtggccctcctgggcgcgatgaccgccgggatcttcctgttcttcatgcagggcaaggggatcggcaagctcagcatgggcctgatcaccatcgccgtggccagcgggctgctctgggtcgccgagatccagccccagtggatcgcggcctccatcatcctggagttcttcctgatggtgctcctgatccccgagccggagaagcagcggaccccccaggacaaccagctgatctacgtgatcctcacgatcctgaccatcatcggcctgatcgccgccaacgagatggggctcatcgagaagaccaagaccgacttcggcttctaccaggtcaagacggagaccaccatcctggacgtggacctgcgccccgccagcgcgtggaccctctacgccgtggccacgaccatcctgacccccatgctgcggcacaccatcgagaacacgtccgccaacctcagcctggccgcgatcgccaaccaggccgccgtcctgatggggctcggcaagggctggccgctgcaccgcatggacctgggggtgcccctcctggccatgggctgctactcccaggtgaaccccaccaccctgaccgcgagcctcgtcatgctgctggtgcactacgccatcatcgggcccggcctccaggccaaggccacgcgggaggcgcagaagcgcaccgccgccggcatcatgaagaacccgaccgtggacgggatcaccgtcatcgacctggagcccatctcctacgaccccaagttcgagaagcagctgggccaggtgatgctcctggtgctgtgcgccgggcagctcctgctgatgcggacgacctgggccttctgcgaggtcctcaccctggcgaccggccccatcctgacgctctgggaggggaacccgggccgcttctggaacaccaccatcgccgtgagcaccgccaacatcttccggggctcctacctggccggggccggcctggcgttcagcctcatcaagaacgcccagacgccccgccgggggaccggcaccaccggggagaccctgggcgagaagtggaagcgccagctgaactccctcgaccggaaggagttcgaggagtacaagcgcagcggcatcctggaggtggaccggacggaggccaagtccgccctgaaggacgggagcaagatcaagcacgccgtctcccgcggcagctccaagatccggtggatcgtggagcgcgggatggtgaagcccaagggcaaggtcgtggacctcgggtgcggccgcggcgggtggagctactacatggcgaccctgaagaacgtgaccgaggtcaagggctacaccaaggggggccccgggcacgaggagccgatccccatggccacgtacggctggaacctggtgaagctccactccggcgtggacgtcttctacaagcccaccgagcaggtggacaccctgctgtgcgacatcggggagagcagctccaaccccaccatcgaggagggccggacgctccgcgtgctgaagatggtcgagccgtggctgagctccaagcccgagttctgcatcaaggtgctgaacccctacatgcccaccgtgatcgaggagctcgagaagctgcagcggaagcacgggggcaacctggtccgctgcccgctcagccggaactccacccacgagatgtactgggtgagcggcgcctccgggaacatcgtcagctccgtgaacaccacgagcaagatgctgctgaaccgcttcaccacccggcaccgcaagcccacctacgagaaggacgtggacctcggcgccgggacgcggtccgtcagcaccgagaccgagaagcccgacatgaccatcatcggccgccggctgcagcgcctgcaggaggagcacaaggagacgtggcactacgaccaggagaacccctaccggacctgggcgtaccacgggtcctacgaggccccgagcaccggctccgccagctccatggtgaacggcgtggtcaagctcctgaccaagccctgggacgtgatccccatggtgacgcagctggccatgaccgacaccaccccgttcgggcagcagcgcgtcttcaaggagaaggtggacacgcggaccccccagcccaagcccggcacccgcatggtgatgaccacgaccgccaactggctctgggcgctgctggggaagaagaagaacccgcggctctgcacccgcgaggagttcatcagcaaggtccggtccaacgccgccatcggcgccgtgttccaggaggagcaggggtggaccagcgccagcgaggcggtgaacgactcccgcttctgggagctggtcgacaaggagcgggccctgcaccaggagggcaagtgcgagagctgcgtgtacaacatgatgggcaagcgcgagaagaagctcggggagttcggccgcgccaaggggtcccgggccatctggtacatgtggctgggcgcccgcttcctggagttcgaggcgctcgggttcctgaacgaggaccactggttcggccgggagaacagctggtccggcgtggagggggagggcctgcaccgcctcgggtacatcctggaggagatcgacaagaaggacggcgacctgatgtacgccgacgacacggccggctgggacacccggatcaccgaggacgacctccagaacgaggagctgatcaccgagcagatggccccccaccacaagatcctggcgaaggccatcttcaagctcacctaccagaacaaggtcgtgaaggtgctgcgccccacgccccggggggccgtcatggacatcatcagccgcaaggaccagcggggctccgggcaggtgggcacctacgggctgaacaccttcaccaacatggaggtgcagctcatccgccagatggaggccgagggcgtcatcacgcaggacgacatgcagaacccgaagggcctgaaggagcgggtggagaagtggctgcgcgagtgcggggtggaccggctcaagcgcatggccatcagcggcgacgactgcgtcgtgaagcccctggacgagcggttcgggacctccctgctcttcctgaacgacatgggcaaggtgcgcaaggacatcccccagtgggagcccagcaaggggtggaagaactggcaggaggtcccgttctgctcccaccacttccacaagatcttcatgaaggacggccggagcctggtggtgccctgccgcaaccaggacgagctcatcggccgggcgcgcatctcccagggggccggctggagcctgcgcgagaccgcctgcctggggaaggcctacgcccagatgtggtccctcatgtacttccaccggcgcgacctgcggctggcgagcatggccatctgctccgccgtccccaccgagtggttccccacgagccgcaccacctggagcatccacgcccaccaccagtggatgaccacggaggacatgctcaaggtgtggaaccgggtgtggatcgaggacaacccgaacatgatcgacaagacccccgtccactcctgggaggacatcccctacctgggcaagcgcgaggacctgtggtgcgggagcctcatcggcctgtccagccgggccacctgggcgaagaacatccacaccgccatcacgcaggtgcgcaacctgatcggcaaggaggagtacgccgactacatgcccgtgatgaagcggtactccgccccgagcgagtccgagggggtcctctga

SEQ ID NO: 10473 - RNA, 9867 nt, synthetic construct
  misc_feature 1..9867: note = derived and/or modified CDS sequence (opt1) from DENV-4__FJ882584__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccaccggcgccgacacgtccgaggtgcactggaactacaaggagcgcatggtcaccttcaaggtgccgcacgcgaagcggcaggacgtgaccgtcctcgggagccaggagggcgccatgcacagcgccctggccggcgccaccgaggtggactccggggacggcaaccacatgttcgcggggcacctgaagtgcaaggtgcgcatggagaagctccgcatcaagggcatgagctacacgatgtgctccggcaagttcagcatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatctccgccacgcccctggcggagaacaccaacagcgtgaccaacatcgagctggagccgcccttcggggactcctacatcgtcatcggcgtgggcaacagcgccctcaccctgcactggttccggaaggggtccagcatcggcaagatgttcgagtccacgtaccgcggggccaagcggatggccatcctgggcgagaccgcgtgggacttcgggagcgtgggcggcctcttcacctccctggggaaggccgtccaccaggtgttcggcagcgtgtacaccacgatgttcgggggcgtctcctggatgatccgcatcctgatcgggttcctcgtgctgtggatcggcaccaacagccggaacacctccatggccatgacctgcatcgccgtgggcgggatcacgctgttcctgggcttcaccgtccaggccgacatggggtgcgtggtgagctggtccggccgcgagctcaagtgcgggagcggcatcttcgtcgtggacaacgtgcacacctggaccgagcagtacaagttccagcccgagagccccgcgcggctggcctccgccatcctgaacgcccacaaggacggcgtctgcgggatccgcagcacgacccggctcgagaacgtgatgtggaagcagatcaccaacgagctgaactacgtgctgtgggagggcgggcacgacctcaccgtcgtggccggcgacgtgaagggcgtcctgacgaaggggaagcgcgcgctgaccccgcccgcctccgacctcaagtacagctggaagacctggggcaaggccaagatcttcacccccgaggcccggaactccacgttcctgatcgacgggcccgacaccagcgagtgcccgaacgagcgccgggcctggaactccttcgaggtggaggactacggcttcgggatgttcaccaccaacatctggatgaagttccgcgagggcagctccgaggtgtgcgaccaccggctgatgagcgcggccatcaaggaccagaaggccgtccacgccgacatgggctactggatcgagtccagcaagaaccagacgtggcagatcgagcgcgcgtccctcatcgaggtgaagacctgcctgtggcccaagacccacaccctgtggagcaacggggtgctcgagtcccagatgctgatccccaagagctacgccggcccgttctcccagcacaactaccggcaggggtacgccacccagacggtcggcccctggcacctggggaagctcgagatcgacttcggcgagtgccccggcaccaccgtgaccatccaggagaactgcgaccaccgcgggcccagcctgcgcacgaccaccgccagcggcaagctggtgacccagtggtgctgccggtcctgcacgatgccgcccctccgcttcctgggggaggacggctgctggtacgggatggagatccggcccctgagcgagaaggaggagaacatggtcaagtcccaggtgaccgccggccagggcaccagcgagaccttctccatggggctcctgtgcctgacgctcttcgtcgaggagtgcctgcgccggcgcgtgacccggaagcacatgatcctggcggtggtcatcaccctctgcgccatcatcctgggcgggctgacctggatggacctcctgcgcgccctgatcatgctcggcgacacgatgagcggccggatcgggggccagacccacctggccatcatggccgtgttcaagatgtcccccgggtacgtgctgggcgtcttcctccgcaagctgaccagccgggagaccgcgctgatggtgatcgggatggccatgacgaccaccctctccatcccgcacgacctgatggagctgatcgacggcatcagcctcggcctgatcctgctcaagatcgtgacccagttcgacaacacgcaggtcgggaccctggccctgtccctcaccttcatccgcagcaccatgtccctggtgatggcctggcggacgatcatggccgtgctgttcgtcgtgaccctcatccccctgtgccgcaccagctgcctgcagaagcagtcccactgggtggagatcaccgcgctcatcctgggcgcccaggccctgcccgtctacctcatgacgctgatgaagggggccagccggcgctcctggcccctgaacgagggcatcatggcggtggggctcgtgagcctgctgggctccgccctcctgaagaacgacgtcccgctggccggccccatggtggccgggggcctcctgctggccgcgtacgtgatgagcgggagctccgccgacctcagcctggagaaggccgccaacgtccagtgggacgagatggccgacatcaccggctccagccccatcatcgaggtgaagcaggacgaggacgggtccttcagcatccgggacgtggaggagaccaacatgatcaccctgctcgtcaagctggcgctgatcacggtgtccggcctctaccccctggccatcccgatcaccatgaccctgtggtacatgtggcaggtgaagacccagcgcagcggcgccctctgggacgtcccctcccccgccgccacccagaaggcggccctgagcgagggggtgtaccggatcatgcagcgcggcctgttcgggaagacgcaggtgggcgtcgggatccacatggagggcgtgttccacaccatgtggcacgtgacccggggctccgtcatctgccacgagaccgggcgcctcgagcccagctgggccgacgtgcgcaacgacatgatctcctacggcgggggctggcggctgggcgacaagtgggacaaggaggaggacgtgcaggtcctggccatcgagccggggaagaaccccaagcacgtgcagacgaagcccggcctcttcaagaccctgaccggggagatcggcgccgtgaccctggacttcaagcccgggacgagcggctccccgatcatcaaccgcaagggcaaggtcatcgggctctacggcaacggggtggtgaccaagagcggcgactacgtctccgcgatcacccaggccgagcggatcggggagcccgactacgaggtggacgaggacatcttccgcaagaagcggctgaccatcatggacctgcaccccggcgccggcaagacgaagcgcatcctcccgagcatcgtgcgggaggccctgaagcgccggctgcgcaccctgatcctcgcgcccacccgggtcgtggccgccgagatggaggaggccctgcgcgggctgcccatccggtaccagacccccgccgtgaagtccgagcacacgggccgcgagatcgtcgacctcatgtgccacgcgaccttcaccacccggctgctgagcagcacgcgcgtgccgaactacaacctcatcgtgatggacgaggcccacttcaccgacccctccagcgtcgccgcccgggggtacatctccacccgcgtggagatgggcgaggccgcggccatcttcatgaccgccacgccccccggggccaccgacccgttcccccagagcaactcccccatcgaggacatcgagcgggagatccccgagcgcagctggaacaccggcttcgactggatcaccgactaccagggcaagacggtctggttcgtgccgtccatcaaggccgggaacgacatcgcgaactgcctgcgcaagagcggcaagaaggtgatccagctgtcccggaagaccttcgacaccgagtaccccaagaccaagctcacggactgggacttcgtcgtgaccaccgacatcagcgagatgggggccaacttccgcgccggccgggtgatcgacccccgccggtgcctgaagcccgtcatcctgaccgacgggccggagcgcgtgatcctcgccggccccatccccgtgacgcccgcgtccgccgcccagcggcgcggccggatcgggcgcaacccggcccaggaggacgaccagtacgtcttcagcggcgaccccctgaagaacgacgaggaccacgcccactggaccgaggcgaagatgctgctcgacaacatctacacccccgaggggatcatccccaccctgttcggcccggagcgggagaagacgcaggccatcgacggcgagttccgcctgcggggggagcagcgcaagaccttcgtggagctcatgcggcgcggcgacctgcccgtgtggctgtcctacaaggtcgccagcgccgggatctcctacaaggaccgggagtggtgcttcaccggcgagcgcaacaaccagatcctcgaggagaacatggaggtggagatctggacccgggagggggagaagaagaagctgcgccccaagtggctggacgcccgggtgtacgcggaccccatggccctcaaggacttcaaggagttcgccagcggccgcaagtccatcaccctggacatcctgacggagatcgccagcctcccgacctacctgtccagccgcgccaagctggcgctcgacaacatcgtcatgctgcacaccaccgagcggggcgggcgcgcctaccagcacgccctgaacgagctccccgagagcctggagacgctgatgctcgtggccctgctgggcgcgatgaccgccgggatcttcctcttcttcatgcagggcaaggggatcggcaagctgtccatgggcctgatcaccatcgccgtggccagcgggctcctgtgggtcgccgagatccagccccagtggatcgcggcctccatcatcctggagttcttcctcatggtgctgctgatcccggagcccgagaagcagcggaccccccaggacaaccagctcatctacgtgatcctgacgatcctgaccatcatcggcctcatcgccgccaacgagatggggctgatcgagaagaccaagaccgacttcggcttctaccaggtcaagacggagaccaccatcctggacgtggacctccgccccgccagcgcgtggaccctgtacgccgtggccacgaccatcctgaccccgatgctccggcacaccatcgagaacacgtccgccaacctgagcctggccgcgatcgccaaccaggccgccgtcctcatggggctgggcaagggctggcccctgcaccgcatggacctcggggtgcccctgctggccatgggctgctactcccaggtgaaccccaccaccctcaccgcgagcctggtcatgctgctcgtgcactacgccatcatcgggccgggcctgcaggccaaggccacgcgggaggcgcagaagcgcaccgccgccggcatcatgaagaaccccaccgtggacgggatcaccgtcatcgacctggagcccatctcctacgaccccaagttcgagaagcagctcggccaggtgatgctgctggtgctctgcgccgggcagctgctgctcatgcggacgacctgggccttctgcgaggtcctgaccctggcgaccggcccgatcctcacgctgtgggaggggaaccccggccgcttctggaacaccaccatcgccgtgagcaccgccaacatcttccggggctcctacctggccggggccggcctcgcgttcagcctgatcaagaacgcccagacgccccgccgggggaccggcaccaccggggagaccctgggcgagaagtggaagcgccagctcaactccctggaccggaaggagttcgaggagtacaagcgcagcggcatcctggaggtggaccggacggaggccaagtccgccctcaaggacgggagcaagatcaagcacgccgtctcccgcggcagctccaagatccggtggatcgtggagcgcgggatggtgaagcccaagggcaaggtcgtggacctggggtgcggccgcggcgggtggagctactacatggcgaccctgaagaacgtgaccgaggtcaagggctacaccaaggggggcccggggcacgaggagcccatccccatggccacgtacggctggaacctcgtgaagctgcacagcggcgtggacgtcttctacaagcccaccgagcaggtggacaccctgctctgcgacatcggggagtccagctccaacccgaccatcgaggagggccggacgctgcgcgtgctgaagatggtcgagccctggctcagctccaagcccgagttctgcatcaaggtgctgaacccctacatgccgaccgtgatcgaggagctggagaagctgcagcggaagcacgggggcaacctcgtccgctgccccctgagccggaactccacccacgagatgtactgggtgagcggcgcctccgggaacatcgtcagctccgtgaacaccacgagcaagatgctgctcaaccgcttcaccacccggcaccgcaagcccacctacgagaaggacgtggacctgggcgccgggacgcggtccgtcagcaccgagaccgagaagcccgacatgaccatcatcggccgccggctgcagcgcctccaggaggagcacaaggagacgtggcactacgaccaggagaacccgtaccggacctgggcgtaccacgggtcctacgaggcccccagcaccggctccgccagctccatggtgaacggcgtggtcaagctgctgaccaagccctgggacgtgatcccgatggtgacgcagctcgccatgaccgacaccacccccttcgggcagcagcgcgtcttcaaggagaaggtggacacgcggaccccccagcccaagccgggcacccgcatggtgatgaccacgaccgccaactggctgtgggcgctgctcgggaagaagaagaacccccggctgtgcacccgcgaggagttcatcagcaaggtccggagcaacgccgccatcggcgccgtgttccaggaggagcaggggtggacctccgccagcgaggcggtgaacgactcccgcttctgggagctggtcgacaaggagcgggccctccaccaggagggcaagtgcgagagctgcgtgtacaacatgatgggcaagcgcgagaagaagctgggggagttcggccgcgccaaggggtcccgggccatctggtacatgtggctgggcgcccgcttcctcgagttcgaggcgctggggttcctgaacgaggaccactggttcggccgggagaacagctggtccggcgtggagggggagggcctccaccgcctggggtacatcctggaggagatcgacaagaaggacggcgacctcatgtacgccgacgacacggccggctgggacacccggatcaccgaggacgacctgcagaacgaggagctgatcaccgagcagatggccccccaccacaagatcctcgcgaaggccatcttcaagctgacctaccagaacaaggtcgtgaaggtgctgcgccccacgccgcggggggccgtcatggacatcatcagccgcaaggaccagcggggctccgggcaggtgggcacctacgggctcaacaccttcaccaacatggaggtgcagctgatccgccagatggaggccgagggcgtcatcacgcaggacgacatgcagaaccccaagggcctgaaggagcgggtggagaagtggctccgcgagtgcggggtggaccggctgaagcgcatggccatcagcggcgacgactgcgtcgtgaagcccctggacgagcggttcgggacctccctcctgttcctgaacgacatgggcaaggtgcgcaaggacatcccccagtgggagccgagcaaggggtggaagaactggcaggaggtccccttctgctcccaccacttccacaagatcttcatgaaggacggccggagcctcgtggtgccctgccgcaaccaggacgagctgatcggccgggcgcgcatctcccagggggccggctggagcctgcgcgagaccgcctgcctcgggaaggcctacgcccagatgtggtccctgatgtacttccaccggcgcgacctgcggctcgcgagcatggccatctgcagcgccgtccccaccgagtggttcccgacgtcccgcaccacctggagcatccacgcccaccaccagtggatgaccacggaggacatgctgaaggtgtggaaccgggtgtggatcgaggacaaccccaacatgatcgacaagacccccgtccactcctgggaggacatcccctacctgggcaagcgcgaggacctctggtgcgggagcctgatcggcctgtccagccgggccacctgggcgaagaacatccacaccgccatcacgcaggtgcgcaacctcatcggcaaggaggagtacgtggactacatgccggtcatgaagcggtactccgcccccagcgagtccgagggggtgctgtga

SEQ ID NO: 10474 - RNA, 9867 nt, synthetic construct
  misc_feature 1..9867: note = derived and/or modified CDS sequence (opt1) from DENV-4__FJ882585__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccaccatcctgggcgggctcacgtggatggacctgctgcgcgccctcatcatgctgggcgacaccatgtccggccggatcgggggccagacccacctggccatcatggccgtgttcaagatgagccccgggtacgtgctcggcgtcttcctgcgcaagctgacctcccgggagacggcgctcatggtgatcgggatggccatgaccaccaccctgagcatcccgcacgacctgatggagctcatcgacggcatctccctgggcctgatcctcctgaagatcgtgacgcagttcgacaacacccaggtcgggaccctggccctcagcctgaccttcatccgctccacgatgagcctggtgatggcctggcggaccatcatggccgtgctcttcgtcgtgaccctgatccccctgtgccgcacctcctgcctccagaagcagagccactgggtggagatcacggcgctgatcctgggcgcccaggccctccccgtctacctgatgaccctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgcgatcaccggcagctcccccatcatcgaggtgaagcaggacgaggacgggagcttctccatccgggacgtggaggagaccaacatgatcacgctcctggtcaagctggccctcatcaccgtgagcggcctgtaccccctggccatcccgatcaccatgaccctctggtacatgtggcaggtgaagacccagcgctccggcgccctgtgggacgtccccagccccgccgcgacgcagaaggccgccctgtccgagggggtgtaccggatcatgcagcgcggcctcttcgggaagacccaggtgggcgtcgggatccacatggagggcgtgttccacaccatgtggcacgtgacccggggcagcgtcatctgccacgagacggggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagaccaagcccggcctgttcaagaccctgaccggggagatcggcgcggtgacgctcgacttcaagcccgggacctccggcagcccgatcatcaaccgcaagggcaaggtcatcgggctgtacggcaacggggtggtgaccaagtccggcgactacgtcagcgccatcacccaggccgagcggatcggggagcccgactacgaggtggacgaggacatcttccgcaagaagcggctgacgatcatggacctccaccccggcgccggcaagaccaagcgcatcctgccgtccatcgtgcgggaggcgctgaagcgccggctgcgcaccctcatcctggcccccacccgggtcgtggccgccgagatggaggaggccctgcgcgggctccccatccggtaccagacgcccgcggtgaagagcgagcacaccggccgcgagatcgtcgacctgatgtgccacgccaccttcaccacgcggctgctctccagcacccgcgtgccgaactacaacctgatcgtgatggacgaggcccacttcaccgaccccagctccgtcgccgcccgggggtacatcagcacccgcgtggagatgggcgaggcggccgccatcttcatgacggccaccccccccggggccaccgacccgttcccccagtccaacagccccatcgaggacatcgagcgggagatccccgagcgctcctggaacaccggcttcgactggatcacggactaccagggcaagaccgtctggttcgtgccgagcatcaaggcggggaacgacatcgccaactgcctgcgcaagtccggcaagaaggtgatccagctcagccggaagaccttcgacaccgagtaccccaagacgaagctgaccgactgggacttcgtcgtgaccaccgacatctccgagatgggggccaacttccgcgccggccgggtgatcgacccccgccggtgcctgaagcccgtcatcctcacggacgggccggagcgcgtgatcctggcgggccccatccccgtgacccccgccagcgccgcccagcggcgcggccggatcgggcgcaacccggcccaggaggacgaccagtacgtcttctccggcgaccccctgaagaacgacgaggaccacgcgcactggaccgaggccaagatgctcctggacaacatctacacccccgaggggatcatccccacgctgttcggcccggagcgggagaagacccaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcgcgggtgtacgccgaccccatggccctgaaggacttcaaggagttcgcctccggccgcaagagcacgaccctggacatcctcaccgagatcgcctccctgccgacctacctgagctcccgcgcgaagctcgccctggacaacatcgtcatgctgcacacgaccgagcggggcgggcgcgcctaccagcacgccctcaacgagctgcccgagagcctggagaccctcatgctggtggcgctgctcggcgccatgaccgccgggatcttcctgttcttcatgcagggcaaggggatcggcaagctgagcatgggcctcatcacgatcgccgtggcctccgggctgctgtgggtcgcggagatccagccccagtggatcgccgccagcatcatcctcgagttcttcctgatggtgctgctcatcccggagcccgagaagcagcggaccccccaggacaaccagctgatctacgtgatcctgaccatcctcaccatcatcggcctgatcgccgccaacgagatggggctgatcgagaagacgaagaccgacttcggcttctaccaggtcaagaccgagaccacgatcctcgacgtggacctgcgccccgcgtccgcctggaccctgtacgccgtggccaccaccatcctcacgccgatgctgcggcacaccatcgagaacaccagcgccaacctgtccctcgcggccatcgccaaccaggccgccgtcctgatggggctgggcaagggctggcccctccaccgcatggacctgggggtgcccctgctcgcgatgggctgctacagccaggtgaaccccaccacgctgaccgcctccctggtcatgctcctggtgcactacgccatcatcgggccgggcctgcaggccaaggcgacccgggaggcccagaagcgcaccgccgccggcatcatgaagaaccccacggtggacgggatcaccgtcatcgacctcgagcccatcagctacgaccccaagttcgagaagcagctgggccaggtgatgctgctcgtgctgtgcgccgggcagctgctcctgatgcggaccacctgggcgttctgcgaggtcctgacgctcgccaccggcccgatcctgaccctgtgggaggggaaccccggccgcttctggaacaccacgatcgccgtgtccaccgccaacatcttccggggcagctacctcgccggggcgggcctggccttctccctgatcaagaacgcccagaccccccgccgggggaccggcaccacgggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccaccctcaagaacgtgacggaggtcaagggctacaccaaggggggcccggggcacgaggagcccatccccatggccacctacggctggaacctggtgaagctgcacagcggcgtggacgtcttctacaagcccaccgagcaggtggacacgctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgaccgtgatcgaggagctggagaagctccagcggaagcacgggggcaacctggtccgctgccccctgtcccggaacagcacgcacgagatgtactgggtgtccggcgccagcgggaacatcgtctccagcgtgaacaccacctccaagatgctcctgaaccgcttcaccacgcggcaccgcaagcccacctacgagaaggacgtggacctgggcgcggggacccggagcgtctccaccgagacggagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtgaacggcgtggtcaagctgctcaccaagccctgggacgtgatcccgatggtgacccagctggccatgaccgacacgacccccttcgggcagcagcgcgtcttcaaggagaaggtggacacccggaccccccagcccaagccgggcacgcgcatggtgatgaccaccaccgcgaactggctgtgggccctcctggggaagaagaagaacccccggctgtgcacgaaggaggagttcatctccaaggtccgcagcaacgccgccatcggcgccgtgttccaggaggagcaggggtggaccagcgcgtccgaggccgtgaacgacagccggttctgggagctcgtcgacaaggagcgcgccctgcaccaggagggcaagtgcgagtcctgcgtgtacaacatgatgggcaagcgggagaagaagctgggggagttcggccgcgccaaggggagccgcgccatctggtacatgtggctcggcgcgcggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgccgacgacaccgccggctgggacacccgcatcaccgaggacgacctgcagaacgaggagctcatcacggagcagatggcgccccaccacaagatcctggccaaggccatcttcaagctgacctaccagaacaaggtcgtgaaggtgctccggcccaccccgcgcggggccgtcatggacatcatctcccggaaggaccagcgcggcagcgggcaggtgggcacctacgggctgaacacgttcaccaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggcgatctccggcgacgactgcgtcgtgaagcccctcgacgagcgcttcgggaccagcctgctgttcctcaacgacatgggcaaggtgcggaaggacatcccccagtgggagccgtccaaggggtggaagaactggcaggaggtccccttctgcagccaccacttccacaagatcttcatgaaggacggccgctccctggtggtgccctgccggaaccaggacgagctgatcggccgcgcccggatcagccagggggccggctggtccctccgcgagacggcctgcctggggaaggcctacgcgcagatgtggagcctgatgtacttccaccgccgggacctccgcctggcctccatggccatctgcagcgccgtccccaccgagtggttcccgaccagccggaccacgtggtccatccacgcccaccaccagtggatgaccaccgaggacatgctgaaggtgtggaaccgcgtgtggatcgaggacaaccccaacatgaccgacaagacgcccgtccacagctgggaggacatcccctacctcggcaagcgggaggacctgtggtgcgggtccctgatcggcctcagctcccgcgcgacctgggccaagaacatccacaccgccatcacccaggtgcggaacctgatcggcaaggaggagtacgtggactacatgccggtcatgaagcgctacagcgccccctccgagagcgagggggtgctgtga

SEQ ID NO: 10475 - RNA, 9867 nt, synthetic construct
  misc_feature 1..9867: note = derived and/or modified CDS sequence (opt1) from DENV-4__FJ882586__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccaccggggagaccctcggcgagaagtggaagcgccagctgaacagcctggaccggaaggagttcgaggagtacaagcgctccggcatcctcgaggtggaccggacggaggccaagagcgccctgaaggacgggtccaagatcaagcacgccgtcagccgcggctccagcaagatccggtggatcgtggagcgcgggatggtgaagcccaagggcaaggtcgtggacctggggtgcggccgcggcgggtggtcctactacatggcgaccctcaagaacgtgaccgaggtcaagggctacaccaaggggggcccggggcacgaggagcccatccccatggccacgtacggctggaacctggtgaagctgcacagcggcgtggacgtcttctacaagcccaccgagcaggtggacaccctcctgtgcgacatcggggagagctccagcaacccgaccatcgaggagggccggacgctgcgcgtgctcaagatggtcgagccctggctgtccagcaagcccgagttctgcatcaaggtgctgaacccctacatgccgaccgtgatcgaggagctggagaagctccagcggaagcacgggggcaacctggtccgctgccccctgtcccggaacagcacccacgagatgtactgggtgtccggcgccagcgggaacatcgtctccagcgtgaacaccacgtccaagatgctcctgaaccgcttcaccacccggcaccgcaagcccacctacgagaaggacgtggacctgggcgccgggacgcggagcgtctccaccgagaccgagaagcccgacatgaccatcatcggccgccggctccagcgcctgcaggaggagcacaaggagacgtggcactacgaccaggagaacccgtaccggacctgggcgtaccacgggagctacgaggccccctccaccggcagcgcctccagcatggtgaacggcgtggtcaagctgctcaccaagccctgggacgtgatcccgatggtgacgcagctggccatgaccgacaccacccccttcgggcagcagcgcgtcttcaaggagaaggtggacacgcggaccccccagcccaagccgggcacccgcatggtgatgaccacgaccgccaactggctgtgggcgctcctggggaagaagaagaacccccggctgtgcacccgcgaggagttcatctccaaggtccggagcaacgccgccatcggcgccgtgttccaggaggagcaggggtggaccagcgcctccgaggcggtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggcgctggggttcctcaacgaggaccactggttcggccgggagaactcctggagcggcgtggagggggagggcctgcaccgcctggggtacatcctcgaggagatcgacaagaaggacggcgacctgatgtacgccgacgacacggccggctgggacacccggatcaccgaggacgacctgcagaacgaggagctcatcaccgagcagatggccccccaccacaagatcctggcgaaggccatcttcaagctgacctaccagaacaaggtcgtgaaggtgctccgccccacgccgcggggggccgtcatggacatcatctcccgcaaggaccagcggggcagcgggcaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggccatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcgcgcatcagccagggggccggctggtccctccgcgagaccgcctgcctggggaaggcctacgcccagatgtggagcctgatgtacttccaccggcgcgacctccggctggcgtccatggccatctgcagcgccgtccccaccgagtggttcccgacgagccgcaccacctggtccatccacgcccaccaccagtggatgaccacggaggacatgctgaaggtgtggaaccgggtgtggatcgaggacaaccccaacatgatcgacaagacccccgtccacagctgggaggacatcccctacctcggcaagcgcgaggacctgtggtgcgggtccctgatcggcctcagctcccgggccacctgggcgaagaacatccacaccgccatcgcccaggtgcgcaacctgatcggcaaggaggagtacgtggactacatgccggtcatgaagcggtacagcgccccctccgagagcgagggggtgctgtga

SEQ ID NO: 10476 - RNA, 9867 nt, synthetic construct
  misc_feature 1..9867: note = derived and/or modified CDS sequence (opt1) from DENV-4__JN819406__SS-prME
  source 1..9867: mol_type = other RNA
agcaccatcaccctgctctgcctgatccccacggtgatggccttccacctgtccacccgcgacggcgagcccctcatgatcgtggccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcgcgcgcgagctgaagtgcggctccgggatcttcgtcgtggacaacgtgcacacctggaccgagcagtaccagttccagcccgagagccccgcccggctggccagcgccatcctcaacgcccacaaggacggcgtctgcggcatccgctccacgacccggctggagaacgtgatgtggaagcagatcaccaacgagctgaactacgtgctctgggagggcgggcacgacctgaccgtcgtggcgggggacgtgaagggcgtcctgacgaagggcaagcgcgccctcaccccgcccgccagcgacctgaagtactcctggaagacctgggggaaggccaagatcttcacccccgaggcccggaacagcacgttcctgatcgacggccccgacacctccgagtgcccgaacgagcgccgggcgtggaacagcttcgaggtggaggactacgggttcggcatgttcaccaccaacatctggatgaagttccgcgaggggtccagcgaggtgtgcgaccaccggctcatgtccgccgccatcaaggaccagaaggccgtccacgcggacatgggctactggatcgagagctccaagaaccagacgtggcagatcgagcgcgccagcctgatcgaggtgaagacctgcctgtggcccaagacccacaccctctggtccaacggcgtgctggagagccagatgctgatccccaagtcctacgccgggccgttcagccagcacaactaccggcagggctacgccacccagacggtcgggccctggcacctcggcaagctggagatcgacttcggggagtgccccggcaccaccgtgaccatccaggagaactgcgaccaccgcggcccctccctgcgcacgaccaccgccagcgggaagctcgtgacccagtggtgctgccggagctgcacgatgccgcccctgcgcttcctgggcgaggacgggtgctggtacggcatggagatccggcccctctccgagaaggaggagaacatggtcaagagccaggtgaccgcggggcagggcacctccgagaccttcagcatgggcctgctgtgcctcacgctgttcgtcgaggagtgcctgcgccggcgcgtgacccggaagcacatgatcctcgccgtggtcatcaccctgtgcgccatcatcctcggcgggctcacctggatggacctgctgcgcgccctcatcatgctgggggacacgatgtccgggcggatcggcgggcagacccacctggccatcatggcggtgttcaagatgagccccggctacgtgctcggggtcttcctgcgcaagctgacctcccgggagaccgccctcatggtgatcggcatggccatgacgaccaccctgagcatcccgcacgacctgatggagctcatcgacgggatctccctgggcctgatcctcctgaagatcgtgacccagttcgacaacacgcaggtcggcaccctggccctcagcctgaccttcatccgctccaccatgagcctggtgatggcctggcggacgatcatggcggtgctgttcgtcgtgaccctgatccccctgtgccgcacctcctgcctccagaagcagagccactgggtggagatcaccgccctgatcctgggggcccaggccctccccgtctacctgatgacgctgatgaagggcgcgtcccggcgcagctggcccctcaacgaggggatcatggccgtgggcctggtgtccctgctcgggagcgccctgctgaagaacgacgtcccgctcgccggccccatggtggccggcgggctgctgctcgcggcctacgtgatgtccggcagcagcgccgacctgtccctggagaaggccgccaacgtccagtgggacgagatggcggacatcaccgggagctcccccatcatcgaggtgaagcaggacgaggacggcagcttctccatccgggacgtggaggagaccaacatgatcaccctcctggtcaagctggccctcatcacggtgagcgggctgtaccccctggccatcccgatcaccatgaccctctggtacatgtggcaggtcaagacccagcgctccggcgccctgtgggacgtccccagccccgccgcgacccagaaggccgccctgtccgagggcgtgtaccggatcatgcagcgcggcctcttcggcaagacccaggtgggggtcggcatccacatggagggggtgttccacaccatgtggcacgtgacccggggcagcgtcatctgccacgagaccggccgcctggagccctcctgggccgacgtgcgcaacgacatgatcagctacgggggcgggtggcggctgggcgacaagtgggacaaggaggaggacgtgcaggtcctcgccatcgagccgggcaagaaccccaagcacgtgcagacgaagcccgggctgttcaagaccctgaccggcgagatcggggcggtgaccctcgacttcaagcccggcacgtccgggagcccgatcatcaaccgcaagggcaaggtcatcggcctgtacgggaacggcgtggtgaccaagtccggggactacgtcagcgccatcacccaggccgagcggatcggcgagcccgactacgaggtggacgaggacatcttccgcaagaagcggctgaccatcatggacctccaccccggggccggcaagacgaagcgcatcctgccgtccatcgtgcgggaggcgctgaagcgccggctgcgcaccctcatcctggcccccacccgggtcgtggccgccgagatggaggaggccctgcgcggcctccccatccggtaccagacccccgcggtcaagagcgagcacacggggcgcgagatcgtcgacctgatgtgccacgccaccttcaccacccggctgctctccagcacgcgcgtgccgaactacaacctgatcgtgatggacgaggcccacttcaccgaccccagctccgtcgccgcccggggctacatcagcacccgcgtggagatgggggaggcggccgccatcttcatgaccgccacgccgcccggcgccaccgacccgttcccccagtccaacagccccatcgaggacatcgagcgggagatccccgagcgctcctggaacaccgggttcgactggatcaccgactaccagggcaagacggtctggttcgtgccgagcatcaaggcgggcaacgacatcgccaactgcctgcgcaagtccgggaagaaggtgatccagctcagccggaagaccttcgacaccgagtaccccaagaccaagctgacggactgggacttcgtcgtgaccaccgacatctccgagatgggcgccaacttccgcgccgggcgggtgatcgacccccgccggtgcctgaagcccgtcatcctcaccgacggcccggagcgcgtgatcctggcggggcccatccccgtgacgcccgccagcgccgcccagcggcgcggccggatcggccgcaacccggcccaggaggacgaccagtacgtcttctccggggaccccctgaagaacgacgaggaccacgcgcactggaccgaggccaagatgctcctggacaacatctacacccccgagggcatcatccccaccctgttcgggccggagcgggagaagacgcaggccatcgacggcgagttccgcctccggggcgagcagcgcaagaccttcgtggagctgatgcggcgcggggacctgcccgtgtggctcagctacaaggtcgcctccgccggcatcagctacaaggaccgggagtggtgcttcaccggggagcgcaacaaccagatcctggaggagaacatggaggtggagatctggacccgggagggcgagaagaagaagctgcgccccaagtggctcgacgcgcgggtgtacgccgaccccatggccctgaaggacttcaaggagttcgcctccgggcgcaagagcatcaccctggacatcctcacggagatcgcctccctgccgacctacctgagctcccgcgcgaagctcgccctggacaacatcgtcatgctgcacaccaccgagcggggcggccgcgcctaccagcacgccctcaacgagctgcccgagagcctggagacgctcatgctggtggcgctgctcggggccatgaccgccggcatcttcctgttcttcatgcaggggaagggcatcgggaagctgagcatgggcctcatcaccatcgccgtggcctccggcctgctgtgggtcgcggagatccagccccagtggatcgccgccagcatcatcctcgagttcttcctgatggtgctgctcatcccggagcccgagaagcagcggacgccccaggacaaccagctgatctacgtgatcctgacgatcctcaccatcatcgggctgatcgccgccaacgagatgggcctgatcgagaagaccaagaccgacttcgggttctaccaggtcaagacggagaccaccatcctcgacgtggacctgcgccccgcgtccgcctggaccctgtacgccgtggccacgaccatcctcaccccgatgctgcggcacaccatcgagaacacgagcgccaacctgtccctcgcggccatcgccaaccaggccgccgtcctgatgggcctggggaagggctggcccctccaccgcatggacctgggcgtgcccctgctcgcgatggggtgctacagccaggtgaaccccaccaccctgaccgcctccctggtcatgctcctggtgcactacgccatcatcggcccggggctgcaggccaaggcgacgcgggaggcccagaagcgcaccgccgccggcatcatgaagaaccccaccgtggacggcatcaccgtcatcgacctcgagcccatcagctacgaccccaagttcgagaagcagctgggccaggtgatgctgctcgtgctgtgcgccggccagctgctcctgatgcggacgacctgggcgttctgcgaggtcctgaccctcgccaccgggccgatcctgacgctgtgggagggcaaccccgggcgcttctggaacaccaccatcgccgtgtccaccgccaacatcttccggggcagctacctcgccggcgcggggctggccttctccctgatcaagaacgcccagacgccccgccggggcaccgggaccaccggcgagaccctcggggagaagtggaagcgccagctgaacagcctggaccggaaggagttcgaggagtacaagcgctccggcatcctcgaggtggaccggacggaggccaagagcgccctgaaggacggctccaagatcaagcacgcggtcagccgcgggtccagcaagatccggtggatcgtggagcgcggcatggtgaagcccaaggggaaggtcgtggacctgggctgcgggcgcggcggctggtcctactacatggccaccctcaagaacgtgaccgaggtcaaggggtacaccaagggcgggccgggccacgaggagcccatccccatggccacgtacgggtggaacctggtgaagctgcacagcggcgtggacgtcttctacaagcccaccgagcaggtcgacaccctcctgtgcgacatcggcgagagctccagcaacccgaccatcgaggaggggcggacgctgcgcgtgctcaagatggtcgagccctggctgtccagcaagcccgagttctgcatcaaggtgctgaacccctacatgccgaccgtgatcgaggagctggagaagctccagcggaagcacggcgggaacctggtccgctgccccctgtcccggaacagcacccacgagatgtactgggtgtccggcgccagcggcaacatcgtctccagcgtgaacaccacgtccaagatgctcctgaaccgcttcaccacccggcaccgcaagcccacctacgagaaggacgtggacctgggggcgggcacgcggagcgtctccaccgagaccgagaagcccgacatgaccatcatcgggcgccggctccagcgcctgcaggaggagcacaaggagacgtggcactacgaccaggagaacccgtaccggacctgggcctaccacggcagctacgaggccccctccaccgggagcgcctccagcatggtgaacggcgtggtcaagctgctcaccaagccctgggacgtgatcccgatggtgacgcagctggccatgaccgacaccacccccttcggccagcagcgcgtcttcaaggagaaggtggacacgcggacgccccagcccaagccggggacccgcatggtgatgaccacgaccgcgaactggctgtgggccctcctgggcaagaagaagaacccccggctgtgcacccgcgaggagttcatctccaaggtccggagcaacgccgccatcggggccgtgttccaggaggagcagggctggaccagcgcgtccgaggccgtgaacgacagccgcttctgggagctcgtcgacaaggagcgggccctgcaccaggaggggaagtgcgagtcctgcgtgtacaacatgatgggcaagcgcgagaagaagctgggcgagttcgggcgcgccaagggcagccgggccatctggtacatgtggctcggggcgcgcttcctggagttcgaggccctgggcttcctcaacgaggaccactggttcgggcgggagaactcctggagcggcgtggagggcgaggggctgcaccgcctgggctacatcctcgaggagatcgacaagaaggacggggacctgatgtacgccgacgacacggccggctgggacacccggatcaccgaggacgacctgcagaacgaggagctcatcaccgagcagatggcgccccaccacaagatcctggccaaggccatcttcaagctgacctaccagaacaaggtcgtgaaggtgctccgccccacgccgcggggcgccgtcatggacatcatctcccgcaaggaccagcgggggagcggccaggtggggacctacggcctgaacaccttcaccaacatggaggtgcagctgatccgccagatggaggccgagggggtcatcacgcaggacgacatgcagaaccccaagggcctcaaggagcgggtggagaagtggctgcgcgagtgcggcgtggaccggctgaagcgcatggcgatctccggggacgactgcgtcgtgaagcccctcgacgagcggttcggcaccagcctgctgttcctcaacgacatggggaaggtgcgcaaggacatcccccagtgggagccgtccaagggctggaagaactggcaggaggtccccttctgcagccaccacttccacaagatcttcatgaaggacgggcggtccctggtggtgccctgccgcaaccaggacgagctgatcggccgggcccgcatcagccagggcgccgggtggtccctccgcgagaccgcctgcctgggcaaggcctacgcgcagatgtggagcctgatgtacttccaccggcgcgacctccggctggcctccatggccatctgcagcgccgtccccaccgagtggttcccgacgagccgcaccacctggtccatccacgcccaccaccagtggatgaccacggaggacatgctgaaggtgtggaaccgggtgtggatcgaggacaaccccaacatgatcgacaagacccccgtccacagctgggaggacatcccctacctcgggaagcgcgaggacctgtggtgcggctccctgatcgggctcagctcccgggcgacctgggccaagaacatccacaccgccatcacccaggtgcgcaacctgatcggcaaggaggagtacgtggactacatgccggtcatgaagcggtacagcgccccctccgagagcgagggcgtgctgtga

SEQ ID NO: 10477 - RNA, 9867 nt, synthetic construct
  misc_feature 1..9867: note = derived and/or modified CDS sequence (opt1) from DENV-4__GQ199876__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtgatcggccgcgtcatcagcgccacgcccctggcggagaacaccaactccgtgaccaacatcgagctcgagccgcccttcggggacagctacatcgtgatcggcgtcggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtgcaccaggtcttcggctccgtgtacaccacgatgttcgggggcgtgagctggatgatccgcatcctcatcgggttcctggtcctgtggatcggcaccaactcccggaacaccagcatggccatgacctgcatcgccgtgggcgggatcacgctgttcctcggcttcaccgtgcaggccgacatggggtgcgtcgtgtcctggagcggccgcgagctgaagtgcgggtccggcatcttcgtggtcgacaacgtgcacacctggaccgagcagtacaagttccagcccgagagccccgcgcggctggccagcgccatcctcaacgcccacaaggacggcgtgtgcgggatccgctccacgacccggctggagaacgtcatgtggaagcagatcaccaacgagctgaactacgtgctctgggagggcgggcacgacctgaccgtggtcgccggcgacgtgaagggcgtgctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtcgaggactacggcttcgggatgttcaccaccaacatctggatgaagttccgcgagggctccagcgaggtgtgcgaccaccggctcatgtccgcggccatcaaggaccagaaggccgtgcacgccgacatgggctactggatcgagagctccaagaaccagacgtggcagatcgagcgcgcgagcctgatcgaggtcaagacctgcctgtggcccaagacccacaccctctggtccaacggggtgctggagagccagatgctgatccccaagtcctacgccggcccgttcagccagcacaactaccggcaggggtacgccacccagacggtgggcccctggcacctcgggaagctggagatcgacttcggcgagtgccccggcaccaccgtcaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtgaagagccaggtcaccgccggccagggcacctccgagaccttcagcatggggctgctgtgcctcacgctgttcgtggaggagtgcctgcgccggcgcgtcacccggaagcacatgatcctcgcggtggtgatcaccctgtgcgccatcatcctgggcgggctcacctggatggacctgctgcgcgccctcatcatgctgggcgacacgatgtccggccggatcgggggccagacccacctggccatcatggccgtcttcaagatgagccccgggtacgtgctcggcgtgttcctgcgcaagctgacctcccgggagaccgcgctcatggtcatcgggatggccatgacgaccaccctgagcatcccgcacgacctgatggagctcatcgacggcatctccctgggcctgatcctcctgaagatcgtgacccagttcgacaacacgcaggtggggaccctggccctcagcctgaccttcatccgctccaccatgagcctggtcatggcctggcggacgatcatggccgtgctcttcgtggtcaccctgatccccctgtgccgcacctcctgcctccagaagcagagccactgggtggagatcaccgcgctgatcctgggcgcccaggccctccccgtgtacctgatgacgctgatgaagggggcctcccggcgcagctggcccctcaacgagggcatcatggcggtcgggctggtgtccctgctcggcagcgccctgctgaagaacgacgtgccgctcgccggccccatggtcgccgggggcctgctgctcgccgcgtacgtgatgtccgggagcagcgccgacctgtccctggagaaggccgccaacgtgcagtgggacgagatggccgacatcaccggcagctcccccatcatcgaggtcaagcaggacgaggacgggagcttctccatccgggacgtggaggagaccaacatgatcaccctcctggtgaagctggcgctcatcacggtcagcggcctgtaccccctggccatcccgatcaccatgaccctctggtacatgtggcaggtgaagacccagcgctccggcgccctgtgggacgtgcccagccccgccgccacccagaaggcggccctgtccgagggggtctaccggatcatgcagcgcggcctcttcgggaagacgcaggtgggcgtggggatccacatggagggcgtcttccacaccatgtggcacgtgacccggggcagcgtgatctgccacgagaccgggcgcctggagccctcctgggccgacgtccgcaacgacatgatcagctacggcgggggctggcggctgggcgacaagtgggacaaggaggaggacgtgcaggtgctcgccatcgagccggggaagaaccccaagcacgtccagacgaagcccggcctgttcaagaccctgaccggggagatcggcgccgtgaccctcgacttcaagcccgggacgtccggcagcccgatcatcaaccgcaagggcaaggtgatcgggctgtacggcaacggggtcgtgaccaagtccggcgactacgtgagcgcgatcacccaggccgagcggatcggggagcccgactacgaggtcgacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtggtcgccgccgagatggaggaggccctgcgcgggctccccgtgcggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccaccggggagaccctcggcgagaagtggaagcgccagctgaacagcctggaccggaaggagttcgaggagtacaagcgctccggcatcctcgaggtggaccggacggaggccaagagcgccctgaaggacgggtccaagatcaagcacgccgtcagccgcggctccagcaagatccggtggatcgtggagcgcgggatggtgaagcccaagggcaaggtcgtggacctggggtgcggccgcggcgggtggtcctactacatggcgaccctcaagaacgtgaccgaggtcaagggctacaccaaggggggcccggggcacgaggagcccatccccatggccacgtacggctggaacctggtgaagctgcacagcggcgtggacgtcttctacaagcccaccgagcaggtggacaccctcctgtgcgacatcggggagagctccagcaacccgaccatcgaggagggccggacgctgcgcgtgctcaagatggtcgagccctggctgtccagcaagcccgagttctgcatcaaggtgctgaacccctacatgccgaccgtgatcgaggagctggagaagctccagcggaagcacgggggcaacctggtccgctgccccctgtcccggaacagcacccacgagatgtactgggtgtccggcgccagcgggaacatcgtctccagcgtgaacaccacgtccaagatgctcctgaaccgcttcaccacccggcaccgcaagcccacctacgagaaggacgtggacctgggcgccgggacgcggagcgtctccaccgagaccgagaagcccgacatgaccatcatcggccgccggctccagcgcctgcaggaggagcacaaggagacgtggcactacgaccaggagaacccgtaccggacctgggcgtaccacgggagctacgaggccccctccaccggcagcgcctccagcatggtgaacggcgtggtcaagctgctcaccaagccctgggacgtgatcccgatggtgacgcagctggccatgaccgacaccacccccttcgggcagcagcgcgtcttcaaggagaaggtggacacgcggaccccccagcccaagccgggcacccgcatggtgatgaccacgaccgccaactggctgtgggcgctcctggggaagaagaagaacccccggctgtgcacccgcgaggagttcatctccaaggtccggagcaacgccgccatcggcgccgtgttccaggaggagcaggggtggaccagcgcctccgaggcggtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggcgctggggttcctcaacgaggaccactggttcggccgggagaactcctggagcggcgtggagggggagggcctgcaccgcctggggtacatcctcgaggagatcgacaagaaggacggcgacctgatgtacgccgacgacacggccggctgggacacccggatcaccgaggacgacctgcagaacgaggagctcatcaccgagcagatggccccccaccacaagatcctggcgaaggccatcttcaagctgacctaccagaacaaggtcgtgaaggtgctccgccccacgccgcggggggccgtcatggacatcatctcccgcaaggaccagcggggcagcgggcaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggccatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcgcgcatcagccagggggccggctggtccctccgcgagaccgcctgcctggggaaggcctacgcccagatgtggagcctgatgtacttccaccggcgcgacctccggctggcgtccatggccatctgcagcgccgtccccaccgagtggttcccgacgagccgcaccacctggtccatccacgcccaccaccagtggatgaccacggaggacatgctgaaggtgtggaaccgggtgtggatcgaggacaaccccaacatgaccgacaagacccccgtccacagctgggaggacatcccctacctcggcaagcgcgaggacctgtggtgcgggtccctgatcggcctcagctcccgggccacctgggcgaagaacatccacacggccatcacccaggtgcgcaacctgatcggcaaggaggagtacgtggactacatgccggtcatgaagcggtacagcgccccctccgagagcgagggggtgctgtga

SEQ ID NO: 10478 - RNA, 9867 nt, synthetic construct
  misc_feature 1..9867: note = derived and/or modified CDS sequence (opt1) from DENV-4__KP723482__SS-prME
  source 1..9867: mol_type = other RNA
agcaccatgaccctgctctgcctgatccccaccgtgatggccttccacctgagcacccgggacggcgagccgctcatgatcgtggccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtgggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcaacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatcagctccacccccttcgcggagaacacgaacagcgtgaccaacatcgagctggagccgcccttcggggactcctacatcgtgatcggcgtcggcgacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtgcaccaggtcttcggcagcgtgtacaccaccatgttcgggggcgtgtcctggatgatccgcatcctgatcgggttcctcgtcctgtggatcggcacgaacagccggaacacctccatggccatgacctgcatcgccgtgggcgggatcaccctgttcctgggcttcacggtgcaggccgacatggggtgcgtcgtgagctggaacggcaaggagctcaagtgcgggtccggcatcttcgtggtcgacaacgtgcacacctggaccgagcagtacaagttccagcccgagagccccgcgcgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgccggcgacgtgaagggcgtgctgaccaaggggaagcgggcgctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctcatcgaggtgaagacgtgcctgtggcccaagacccacaccctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcacgaccgtcaccatccaggaggactgcgaccaccgggggccctccctgcgcaccacgaccgccagcggcaagctggtgacccagtggtgctgccgctcctgcaccatgccgcccctccggttcctgggggaggacggctgctggtacgggatggagatccgccccctgagcgagaaggaggagaacatggtcaagagccaggtcacggccggccagggcacctccgagaccttcagcatggggctcctgtgcctgaccctcttcgtggaggagtgcctgcggcgccgggtcacgcgcaagcacatgatcctggcggtggtgatcaccttctgcgccatcatcctcggcgggctgacctggatggacctgctccgggtcctgatcatgctgggcgacaccatgtccggccgcatcgggggccagatccacctcgccatcatggccgtgttcaagatgagccccgggtacgtgctgggcgtcttcctgcggaagctcacgtcccgcgagaccgccctgatggtgatcgggatggcgatgaccaccgtgttcagcatcccgcacgacctgatggagctcatcgacggcatctccctgggcctgatcctcctgaagatcgtcacgcacttcgacaacacccaggtggggaccctggccctcagcctgaccttcatccggtccacgacgcccctggtgatggcctggcgcaccatcatggccgtcttcttcgtggtgaccctcatccccctgtgccggacgagctgcctgcagaagcagtcccactgggtcgagatcaccgccctcatcctgggcgcgcaggccctgcccgtgtacctcatgaccctgatgaagggggccagccgccggtcctggccgctgaacgagggcatcatggccgtggggctcgtcagcctgctgggctccgcgctcctgaagaacgacgtgcccctggccggccccatggtggccgggggcctcctgctggccgcctacgtcatgagcgggtccagcgcggacctctccctggagaaggccgccaacgtgcagtgggacgagatggccgacatcaccggcagcagccccatcatcgaggtgaagcaggacgaggacgggtccttcagcatccgcgacgtcgaggagacgaacatgatcaccctgctcgtgaagctggccctgatcaccgtgtccggcctctacccgctggcgatccccgtcaccatggccctgtggtacgtgtggcaggtcaagacgcagcggagcggcgccctctgggacgtcccctcccccagcgccacccagaaggccaccctgtccgagggggtgtaccgcatcatgcagcggggcctgttcgggaagacccaggtgggcgtcgggatccacatggagggcgtgttccacaccatgtggcacgtgacgcgcggcagcgtcatctgccacgagaccgggcggctcgagccgtcctgggcggacgtgcgcaacgacatgatcagctacggcgggggctggcgcctgggcgacaagtgggacaaggaggaggacgtgcaggtcctggccatcgagcccgggaagaaccccaagcacgtgcagaccaagcccggcctcttcaagaccctgacgggggagatcggcgccgtgaccctggacttcaagccggggacctccggcagccccatcatcaacaagaagggcaaggtcatcgggctctacggcaacggggtggtgaccaagtccggcgactacgtcagcgccatcacgcaggccgagcggatcggggagcccgactacgaggtggacgaggacatcttccgcaagaagcggctgaccatcatggacctgcacccgggcgcgggcaagaccaagcgcatcctcccctccatcgtgcgggaggccctgaagcgccggctgcgcaccctcatcctggcccccacgcgggtcgtggccgcggagatggaggaggccctgcgcgggctgcccatccggtaccagaccccggccgtcaagagcgagcacaccggccgcgagatcgtcgacctcatgtgccacgccaccttcacgacccggctgctgtccagcacccgcgtgcccaactacaacctcatcgtcatggacgaggcccacttcaccgacccctgctccgtggcggcccgggggtacatcagcacgcgcgtggagatgggcgaggccgccgccatcttcatgaccgcgacgcccccggggagcatcgaccccttcccccagtccaacagccccatcgaggacatcgagcgggagatcccggagcgctcctggaacaccggcttcgactggatcacggactaccagggcaagaccgtctggttcgtgcccagcatcaaggccgggaacgacatcgccaactgcctgcggaagtccggcaagcgcgtgatccagctgagccgcaagaccttcgacaccgagtaccccaagacgaagctcaccgactgggacttcgtcgtgaccaccgacatctccgagatgggggccaacttccgggccggccgcgtgatcgacccccggcgctgcctgaagccggtcatcctgacggacgggcccgagcgggtgatcctcgcgggccccatccccgtgaccccggccagcgccgcccagcgccggggccgcatcgggcggaaccccgcgcaggaggacgaccagtacgtcttctccggcgaccccctgaagaacgacgaggaccacgcccactggaccgaggccaagatgctgctcgacaacatctacacccccgaggggatcatcccgacgctgttcggccccgagcgcgagaagacccaggccatcgacggcgagttccggctgcgcggggagcagcggaagaccttcgtggagctcatgcgccggggcgacctgcccgtgtggctgagctacaaggtcgcctccgcggggatcagctacaaggaccgcgagtggtgcttcaccggcgagcggaacaaccagatcctcgaggagaacatggaggtggagatctggacgcgcgagggggagaagaagaagctgcggcccaagtggctggacgcccgcgtgtacgccgacccgatggccctcaaggacttcaaggagttcgcctccggccgcaagagcatcaccctggacatcctgaccgagatcgcgaccctccccacctacctgtccagcaaggccaagctggccctcgacaacatcgtcatgctgcacacgaccgagaagggcgggcgcgcctaccagcacgccctgaacgagctccccgagtccctggagaccctgatgctcgtggcgctgctgggcgccatgaccgccgggatcttcctcttcttcatgcagggcaaggggatcggcaagctgagcatgggcctgatcgccatcgcggtggcctccgggctcctgtgggtcgccgagatccagccgcagtggatcgccgccagcatcatcctggagttcttcctcatggtgctgctgatccccgagcccgagaagcagcgcacgccccaggacaaccagctcatctacgtgatcctgaccatcctgaccatcatcggcctcatcgcggccaacgagatggggctgatcgagaagaccaagacggacttcggcttctaccaggtcaagccggagaccaccatcctggacgtggacctccggcccgccagcgcctggaccctgtacgccgtggcgacgaccatcctgacccccatgctccgccacaccatcgagaacacgtccgccaacctgagcctggccgccatcgccaaccaggcggccgtcctcatggggctgggcaagggctggcccctgcaccggatggacctcggggtgccgctgctggccatgggctgctactcccaggtgaaccccaccaccctcaccgccagcctggtcatgctgctcgtgcactacgccatcatcgggcccggcctgcaggcgaaggccacgcgcgaggcccagaagcggaccgccgcgggcatcatgaagaaccccaccgtggacgggatcaccgtcatcgacctggagccgatctcctacgaccccaagttcgagaagcagctcggccaggtgatgctgctggtgctctgcgtcgggcagctgctgctcatgcgcacgacctgggccctgtgcgaggtgctgaccctcgccaccggccccgtgatgacgctgtgggaggggaaccccggccggttctggaacaccaccatcgccgtcagcaccgccaacatcttccgcggctcctacctggcgggggccggcctcgccttcagcctgatcaagaacgcccagacgccgcggcgcgggaccggcaccaccggggagacgctgggcgagaagtggaagcggcagctcaactccctggaccgcaaggagttcgaggagtacaagcggagcggcatcctggaggtggaccgcaccgaggccaagtccgcgctccgggacgggaccaagatcaagtacgccgtgagccgcggctccagcaagatccggtggatcgtcgagcgcgggatgatcaagcccaagggcaaggtggtggacctggggtgcggccggggcgggtggtcctactacatggccaccctgaagaacgtcaccgaggtgaagggctacacgaagggcggccccgggcacgaggagcccatcccgatggccacctacggctggaacctcgtgaagctgcacagcggcgtcgacgtgttctacaagcccaccgagcaggtcgacaccctgctctgcgacatcggggagtccagctccaaccccacgatcgaggagggccgcaccctgcgcgtcctgaagatggtggagccctggctcagcagcaagccggagttctgcatcaaggtcctgaacccctacatgcccaccgtgatcgaggagctggagaagctccagcggcgccacgggggctccctggtgcggtgccccctgagccgcaactccacccacgagatgtactgggtcagcggcgcctccgggaacatcgtgagctccgtgaacacgatcagcaagatgctgctcaaccggttcaccacccgccaccggaagccgacctacgagaaggacgtcgacctgggcgcggggacgcgctccgtgagcaccgagaccgagaagcccgacatgaccgtgatcggccggcgcctgcagcggctccgcgaggagcacaaggagacgtggcactacgaccaggagaacccctaccggacctgggcctaccacgggtcctacgaggccccgagcaccggctccgccagctccatggtcaacggcgtggtgaagctgctgaccaagccctgggacgtcatccccatggtgacgcagctcgcgatgaccgacaccacccccttcgggcagcagcgcgtgttcaaggagaaggtcgacacgcggaccccgcagcccaagcccggcacccgcatgatcatgaccacgaccgccaactggctgtgggccctgctcgggaagaagaagtccccgcggctgtgcacccgcgaggagttcatctccaaggtgcggagcaacgccgccatcggcgcggtgttccaggaggagcaggggtggacctccgccagcgaggccgtcaacgacagccgcttctgggagctggtggacaaggagcgggccctccaccaggagggcaagtgcgagtcctgcgtgtacaacatgatgggcaagcgcgagaagaagctgggggagttcggccgcgccaaggggagccgggcgatctggtacatgtggctgggcgcccgcttcctcgagttcgaggccctggggttcctgaacgaggaccactggttctcccgggagaacagctggtccggcgtcgagggcgaggggctccaccgcctgggctacatcctggaggacatcgacaagaaggacggggacctcatctacgccgacgacacggccggctgggacacccggatcaccgaggacgacctgctgaacgaggagctcatcaccgagcagatggcgccccaccacaagacgctggccaaggccatcttcaagctgacctaccagaacaaggtggtgaaggtcctccgccccacccccaagggcgccgtgatggacatcatcagccggaaggaccagcgcgggtccggccaggtggggacctacggcctgaacaccttcacgaacatggaggtccagctgatccggcagatggaggcggagggggtgatcacccaggacgacatgcagaaccccaagggcctcaaggagcgcgtggagaagtggctgaaggagtgcggcgtcgaccggctgaagcgcatggccatcagcggggacgactgcgtggtgaagccgctcgacgagcggttctccaccagcctgctgttcctcaacgacatgggcaaggtccgcaaggacatcccccagtgggagccctccaaggggtggaagaactggcaggaggtgcccttctgcagccaccacttccacaagatcttcatgaaggacggccggtccctggtggtcccgtgccgcaaccaggacgagctgatcgggcgggcccgcatcagccagggcgccggctggtccctccgggagaccgcctgcctggggaaggcgtacgcccagatgtggagcctgatgtacttccaccgccgcgacctccggctggcctccatggccatctgcagcgccgtgcccacggagtggttccccaccagccgcaccacctggtccatccacgcgcaccaccagtggatgacgaccgaggacatgctgaaggtgtggaaccgggtctggatcgaggacaaccccaacatgaccgacaagaccccggtgcacagctgggaggacatcccctacctcggcaagcgcgaggacctgtggtgcgggtccctgatcggcctcagctcccgggccacgtgggccaagaacatccacaccgccatcacccaggtgcgcaacctgatcgggaaggaggagtacgtcgactacatgcccgccatgaagcggtacagcgcgcccttcgagtccgagggcgtgctgtga

SEQ ID NO: 10479 - RNA, 9867 nt, synthetic construct
  misc_feature 1..9867: note = derived and/or modified CDS sequence (opt1) from DENV-4__JN638570__SS-prME
  source 1..9867: mol_type = other RNA
agcaccatcaccctgctctgcctgatccccaccgtgatggcgttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcgcctgggtcatgtacgggacctgcacccagtccggggagcggcgccgggagaagcgcagcgtggccctgacgccccactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtcttcttcatcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgacgaccatggcccagggcaagcccaccctggacttcgagctcatcaagaccacggccaaggaggtcgccctgctgcggacctactgcatcgaggcgtccatcagcaacatcaccaccgccacgcgctgcccgacccagggggagccctacctcaaggaggagcaggaccagcagtacatctgccggcgcgacatggtggaccggggctgggggaacggctgcggcctgttcgggaagggcggggtggtgacctgcgccaagttctcctgcctgggcaagatcaccgggaacctcgtgcagatcgagaacctggagtacacggtggtcgtgaccgtgcacaacggcgacacccacgccgtcggcaacgacaccagcaaccacggggtgacggccaccatcacgccccgctcccccagcgtcgaggtgaagctgccggactacggcgagctcaccctggactgcgagccccggtccgggatcgacttcaacgagatgatcctgatgaagatgaagacgaagacctggctcgtgcacaagcagtggttcctggacctgcccctcccctggaccaccggcgcggacaccctggaggtccactggaaccacaaggagcgcatggtgacgttcaaggtgccgcacgccaagcggcaggacgtcaccgtgctggggagccaggagggcgccatgcactccgccctcgccggcgcgaccgaggtggacagcggggacggcaaccacatgttcgccgggcacctgaagtgcaaggtccgcatggagaagctgcgcatcaagggcatgagctacaccatgtgctccggcaagttcagcatcgacaaggagatggccgagacgcagcacgggaccaccgtggtgaaggtcaagtacgagggcaccggggccccctgcaaggtgcccatcgagatccgggacgtgaacaaggagaaggtcgtgggccgcatcatctccagcacgcccttcgccgagaacaccaactccgtgaccaacatcgagctcgagccgcccttcggggacagctacatcgtcatcggcgtgggcgacggggcgctgaccctgcactggttccggaagggctccagcatcgggaagatgttcgagtccacgtaccgcggcgccaagcggatggccatcctcggggagaccgcctgggacttcggcagcgtgggcgggctgctgacctccctcggcaaggcggtccaccaggtgttcgggagcgtgtacaccacgatgttcggcggggtctcctggatggtgcgcatcctgatcggcctgctggtgctctggatcggcaccaacagccggaacacctccatggccatgagctgcatcgccgtcgggggcatcaccctgttcctggggttcacggtgcacgccgacatgggctgcgtggtctcctggagcgggaaggagctcaagtgcggctccggcatcttcgtgatcgacaacgtgcacacctggaccgagcagtacaagttccagcccgagagccccgcccgcctggcgagcgccatcctgaacgcccacaaggagggggtctgcggcatccggtccaccacgcgcctcgagaacgtgatgtggaagcagatcaccaacgagctgaactacgtgctgtgggagggcgggcacgacctcaccgtcgtggccggcgacgtgaagggggtcctgagcaagggcaagcgggccctggcgccgcccgtgaacgacctcaagtactcctggaagacctgggggaaggccaagatcttcacgcccgagacccgcaacagcaccttcctggtggacggccccgacacctccgagtgcccgaacgagcggcgcgcctggaacttcctggaggtcgaggactacgggttcggcatgttcacgaccaacatctggatgaagttccgggagggcagccccgaggtgtgcgaccaccgcctcatgtccgccgccatcaaggaccagaaggcggtgcacgccgacatggggtactggatcgagagctccaagaaccagacctggcagatcgagaaggccagcctgatcgaggtcaagacctgcctgtggcccaagacgcacaccctctggtccaacggcgtgctggagagccagatgctgatcccgaaggcctacgcggggcccatctcccagcacaactaccggcagggctacgccacccagaccgccgggccctggcacctcggcaagctggagatcgacttcggcgagtgccccgggaccacggtgaccgtccaggaggactgcgaccaccgcggcccgagcctgcggaccaccacggcctccgggaagctcgtgacccagtggtgctgccgcagctgcaccatgccgcccctgcgcttcctgggcgaggacgggtgctggtacggcatggagatccggcccctcaacgagaaggaggagaacatggtgaagtcccaggtcagcgccggccaggggaccagcgagacgttctccatgggcctgctgtgcctcaccctgttcgtggaggagtgcctgcgccggcgcgtcacccggaagcacatgatgctcgtggtggtcaccacgctgtgcgcgatcatcctcgggggcctcacctggatggacctgctgcgcgccctcatcatgctgggcgacaccatgagcgggcggatgggcgggcagatccacctggccatcatggccgtgttcaagatgtccccgggctacgtgctcgggatcttcctgcgcaagctgaccagccgggagacggccctcatggtcatcggcatggcgatgaccaccgtgctggccatcccccacgacctgatggagttcatcgacggcatctccctcgggctgatcctgctcaagatggtgacccacttcgacaacacgcaggtcggcaccctggccctggccctcaccttcatcaagagcaccatgcccctggtgatggcctggcgcacgatcatggcggtgctgttcgtcgtgaccctcatccccctgtgccggacctcctgcctgcagaagcagagccactgggtggagatcaccgccctcatcctgggggcccaggccctgccggtctacctcatgacgctgatgaagggcgcgtccaagcgcagctggcccctgaacgaggggatcatggccgtgggcctcgtgtccctgctgggcagcgccctcctgaagaacgacgtccccctggccgggcccatggtggccggcgggctcctgctggcggcctacgtgatgtccggcagctccgccgacctcagcctggagaaggccgccaacgtccggtgggacgagatggcggacatcaccgggtccagcccgatcatcgaggtgaagcaggacgaggacggctccttcagcatccgcgacgtggaggagaccaacatgatcaccctgctcgtcaagctggccctgatcacggtgagcggcctctaccccctggccatccccgtgaccatgaccctgtggtacatgtggcaggtcaagacccagcggtccggggccctctgggacgtgcccagcccggccgcggcccagaaggccacgctgaccgagggcgtgtaccgcatcatgcagcgggggctgttcggcaagacccaggtcggggtgggcatccacaccgagggcgtgttccacaccatgtggcacgtcacgcgcgggtccgtgatctgccacgagagcggccggctcgagccctcctgggccgacgtgcgcaacgacatgatcagctacgggggcggctggcggctgggggacaagtgggacaaggaggaggacgtccaggtgctggccatcgagcccggcaagaaccccaagcacgtgcagaccaagccggggctgttcaagaccctgaccggcgagatcggggcggtcacgctggacttcaagcccggcacctccggcagccccatcatcaaccgcaaggggaaggtgatcggcctctacgggaacggcgtggtcaccaagtccggggactacgtgagcgccatcacccaggccgagcgcatcggcgagccggactacgaggtggacgaggacatcttccggaagaagcgcctgacgatcatggacctgcaccccggcgccgggaagaccaagcggatcctgccctccatcgtccgcgaggcgctcaagcggcgcctgcggaccctgatcctcgcccccacccgcgtggtggccgccgagatggaggaggccctgcggggcctgccgatccgctaccagacgcccgcggtcaagagcgagcacaccgggcgggagatcgtggacctcatgtgccacgccaccttcaccacgcgcctgctgtccagcacccgggtgcccaactacaacctcatcgtcatggacgaggcccacttcaccgacccctccagcgtggccgcccgcggctacatctccacccgggtcgagatgggggaggcggccgccatcttcatgacggccaccccgcccggcaccaccgaccccttcccccagagcaactccccgatcgaggacatcgagcgcgagatccccgagcggagctggaacacgggcttcgactggatcaccgactaccaggggaagaccgtgtggttcgtgcccagcatcaaggccggcaacgacatcgcgaactgcctgcgcaagtccgggaagaaggtcatccagctgagccggaagaccttcgacacggagtaccccaagaccaagctcaccgactgggacttcgtggtgaccacggacatctccgagatgggcgccaacttccgcgccgggcgcgtcatcgacccgcggcgctgcctgaagcccgtgatcctgaccgacggccccgagcgggtgatcctcgccggccccatcccggtcacccccgcgagcgccgcccagcgccgggggcgcatcggccggaaccccgcccaggaggacgaccagtacgtgttctccggggaccccctgcgcaacgacgaggaccacgcccactggaccgaggcgaagatgctgctcgacaacatctacacgccggagggcatcatccccaccctgttcggccccgagcgggagaagacccaggccatcgacggggagttccgcctgcggggcgagcagcgcaagaccttcgtggagctcatgcggcgcggggacctgcccgtctggctgagctacaaggtggcctccgccggcatcagctacaaggaccgggagtggtgcttcacgggggagcgcaacaaccagatcctcgaggagaacatggaggtggagatctggacccgggagggcgagaagaagaagctgcgcccgaagtggctggacgcccgggtctacgcggaccccatggccctcaaggacttcaaggagttcgcctccggccgcaagagcatcaccctggacatcctgaccgagatcgcctccctccccacctacctgagctcccgggccaagctggcgctcgacaacatcgtgatgctgcacacgaccgagcgcgggggcaaggcctaccagcacgccctgaacgagctcccggagagcctggagaccctgatgctcgtggccctgctgggggcgatgaccgccggcatcttcctcttcttcatgcaggggaagggcatcggcaagctgtccatggggctgatcgccatcgccgtcgccagcggcctcctgtgggtggcggagatccagccccagtggatcgccgcctccatcatcctggagttcttcctcatggtgctgctggtccccgagcccgagaagcagcgcacgccgcaggacaaccagctcatctacgtgatcctgaccatcctgaccatcatcgccctcgtggccgcgaacgagatggggctgatcgagaagaccaagacggacttcggcttctaccaggtcaaggccgagaccaccatcctggacgtggacctccggcccgccagcgcctggaccctgtacgccgtggcgacgaccatcctgacccccatgctccgccacaccatcgagaacacgtccgccaacctgagcctggccgccatcgccaaccaggcggccgtcctcatggggctgggcaagggctggcccctgcaccggatggacctcggggtgccgctgctggccatgggctgctacagccaggtgaaccccaccaccctcaccgcctccctggtcatgctgctcgtgcactacgcgatcatcgggcccggcctgcaggccaaggccacgcgcgaggcccagaagcggaccgccgcgggcatcatgaagaaccccaccgtggacgggatcaccgtcatcgacctggagccgatcagctacgaccccaagttcgagaagcagctcggccaggtgatgctgctggtgctctgcgccgggcagctgctgctcatgcgcacgacctgggccttctgcgaggtcctgaccctggccaccggccccatcctcacgctgtgggaggggaaccccggccggttctggaacaccaccatcgccgtgtccaccgcgaacatcttccgcggcagctacctggccggggccggcctcgccttctccctgatcaagaacgcccagacgccgcggcgcgggaccggcaccaccggggagacgctgggcgagaagtggaagcggcagctcaacagcctggaccgcaaggagttcgaggagtacaagcggtccggcatcctggaggtggaccgcaccgaggccaagagcgccctcaaggacgggtccaagatcaagtacgccgtcagccggggcacctccaagatccgctggatcgtggagcgggggatggtgaagcccaagggcaaggtcgtggacctggggtgcggccgcggcgggtggagctactacatggccaccctgaagaacgtgaccgaggtcaagggctacacgaagggcggccccgggcacgaggagcccatcccgatggcgacctacggctggaacctcgtgaagctgcactccggcgtggacgtcttctacaagcccaccgagcaggtcgacaccctgctctgcgacatcggggagagctccagcaaccccacgatcgaggagggccggaccctgcgcgtgctgaagatggtcgagccctggctgtccagcaagccggagttctgcatcaaggtgctcaacccctacatgcccaccgtcatcgaggagctggagaagctgcagcgccggtacgggggctccctcgtgcgctgccccctgagccggaacagcacccacgagatgtactgggtgtccggcgtcagcgggaacatcgtgtccagcgtgaacacgacctccaagatgctgctcaaccgcttcaccacccggcaccgcaagccgacgtacgagcgggacgccgacctgggcgccgggacccgcagcgtctccaccgagaccgagaagcccgacatgacgatcatcggccggcgcctgcagcggctccaggaggagcacaaggagacctggcactacgaccacgagaacccctaccgcacctgggcctaccacgggagctacgaggccccgtccaccggcagcgcgtccagcatggtgaacggcgtggtcaagctgctgacgaagccctgggacgtggtgcccatggtcacccagctcgccatgaccgacaccacgcccttcgggcagcagcgggtgttcaaggagaaggtggacacccgcaccccgcagcccaagcccggcacccgggtcgtgatgacgaccaccgccaactggctgtggaccctgctcgggcgcaagaagaacccccggctgtgcacgcgcgaggagttcatctccaaggtgcggagcaacgccgccatcggcgcggtcttccaggaggagcaggggtggacctccgccagcgaggccgtgaacgactcccgcttctgggagctggtggacaaggagcgggccctccaccaggagggcaagtgcgagagctgcgtctacaacatgatgggcaagcgcgagaagaagctgggggagttcggccgcgccaaggggtcccgggcgatctggtacatgtggctgggcgcccgcttcctcgagttcgaggccctggggttcctgaacgaggaccactggttcggccgggagaacagctggagcggcgtggagggggagggcctccaccgcctggggtacatcctggaggacatcgacaagaaggacggcgacctcatctacgccgacgacaccgcgggctgggacacccggatcacggaggacgacctgctgaacgaggagctcatcaccgagcagatggccccgcaccacaagatcctggccaaggccatcttcaagctgacctaccagaacaaggtggtcaaggtgctccgccccacccccaagggggccgtgatggacatcatctcccggaaggaccagcgcggcagcgggcaggtcggcacctacgggctgaacacgttcaccaacatggaggtgcagctgatccggcagatggaggcggagggcgtgatcacccgcgacgacatgcacaaccccaagggcctcaaggagcgggtcgagaagtggctgaaggagtgcggggtggaccgcctgaagcggatggccatctccggcgacgactgcgtggtcaagccgctcgacgagcgcttcagcacctccctgctgttcctcaacgacatggggaaggtgcggaaggacatcccccagtgggagcccagcaagggctggaagaactggcaggaggtgcccttctgctcccaccacttccacaagatcttcatgaaggacgggcgcagcctggtcgtgccgtgccggaaccaggacgagctgatcggccgcgcccggatctcccagggcgccgggtggagcctccgcgagacggcctgcctgggcaaggcgtacgcccagatgtggtccctgatgtacttccaccgccgggacctccgcctggccagcatggccatctgctccgccgtgcccaccgagtggttccccaccagccggaccacgtggtccatccacgcgcaccaccagtggatgaccaccgaggacatgctgaaggtctggaaccgcgtgtggatcgaggacaaccccaacatgatcgacaagaccccggtgcacagctgggaggacatcccctacctcgggaagcgggaggacctgtggtgcggctccctgatcgggctcagcagccgcgccacgtgggccaagaacatccacaccgccatcacccaggtccggaacctgatcggcaaggaggagtacgtggactacatgcccgccatgcgccggtactccgcgcacttcgagagcgagggcgtgctgtga

SEQ ID NO: 10480 - RNA, 9867 nt, synthetic construct
  misc_feature 1..9867: note = derived and/or modified CDS sequence (opt1) from DENV-4__JN638571__SS-prME
  source 1..9867: mol_type = other RNA
agcaccatcaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccagcgcctgggtcatgtacgggacctgcacccagtccggggagcggcgccgggagaagcgcagcgtggccctgaccccgcactccggcatgggcctcgagacgcgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtcttcttcatcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgacgaccatggcccagggcaagcccaccctggacttcgagctcatcaagaccacggccaaggaggtcgccctgctgcggacctactgcatcgaggcgtccatcagcaacatcaccaccgccacgcgctgcccgacccagggggagccctacctcaaggaggagcaggaccagcagtacatctgccggcgcgacatggtggaccggggctgggggaacggctgcggcctgttcgggaagggcggggtggtgacctgcgccaagttctcctgcctgggcaagatcaccgggaacctcgtgcagatcgagaacctggagtacacggtggtcgtgaccgtgcacaacggcgacacccacgccgtcggcaacgacaccagcaaccacggggtgacggccaccatcacgccccgctcccccagcgtcgaggtgaagctgccggagtacggcgagctcaccctggactgcgagccccggtccgggatcgacttcaacgagatgatcctgatgaagatgaagacgaagacctggctcgtgcacaagcagtggttcctggacctgcccctcccctggaccaccggcgcggacaccctggaggtccactggaaccacaaggagcgcatggtgacgttcaaggtgccgcacgccaagcggcaggacgtcaccgtgctggggagccaggagggcgccatgcactccgccctcgccggcgcgaccgaggtggacagcggggacggcaaccacatgttcgccgggcacctgaagtgcaaggtccgcatggagaagctgcgcatcaagggcatgagctacaccatgtgctccggcaagttcagcatcgacaaggagatggccgagacgcagcacgggaccaccgtggtgaaggtcaagtacgagggcaccggggccccctgcaaggtgcccatcgagatccgggacgtgaacaaggagaaggtcgtgggccgcatcatctccagcacgcccttcgccgagaacaccaactccgtgaccaacatcgagctcgagccgcccttcggggacagctacatcgtcatcggcgtgggcgacggggcgctgaccctgcactggttccggaagggctccagcatcgggaagatgttcgagtccacgtaccgcggcgccaagcggatggccatcctcggggagaccgcctgggacttcggcagcgtgggcgggctgctgacctccctcggcaaggcggtccaccaggtgttcgggagcgtgtacaccacgatgttcggcggggtctcctggatggtgcgcatcctgatcggcctgctggtgctctggatcggcaccaacagccggaacacctccatggccatgagctgcatcgccgtcgggggcatcaccctgttcctggggttcacggtgcacgccgacatgggctgcgtggtctcctggagcgggaaggagctcaagtgcggctccggcatcttcgtgatcgacaacgtgcacacctggaccgagcagtacaagttccagcccgagagccccgcccgcctggcgagcgccatcctgaacgcccacaaggagggggtctgcggcatccggtccaccacgcgcctcgagaacgtgatgtggaagcagatcaccaacgagctgaactacgtgctgtgggagggcgggcacgacctcaccgtcgtggccggcgacgtgaagggggtcctgagcaagggcaagcgggccctggcgccgcccgtgaacgacctcaagtactcctggaagacctgggggaaggccaagatcttcacgcccgagacccgcaacagcaccttcctggtggacggccccgacacctccgagtgcccgaacgagcggcgcgcctggaacttcctggaggtcgaggactacgggttcggcatgttcacgaccaacatctggatgaagttccgggagggcagctccgaggtgtgcgaccaccgcctcatgagcgccgccatcaaggaccagaaggcggtgcacgccgacatggggtactggatcgagtccagcaagaaccagacctggcagatcgagaaggcctccctgatcgaggtcaagacctgcctgtggcccaagacgcacaccctctggagcaacggcgtgctggagtcccagatgctgatccccaaggcctacgcggggccgatcagccagcacaactaccggcagggctacgccacccagaccgccgggccctggcacctcggcaagctggagatcgacttcggcgagtgccccgggaccacggtgaccgtccaggaggactgcgaccaccgcggcccctccctgcggaccaccacggccagcgggaagctcgtgacccagtggtgctgccgctcctgcaccatgccgcccctgcgcttcctgggcgaggacgggtgctggtacggcatggagatccggcccctcaacgagaaggaggagaacatggtcaagagccaggtcagcgccggccaggggacctccgagacgttcagcatgggcctgctgtgcctcaccctgttcgtggaggagtgcctgcgccggcgcgtcacccggaagcacatgatgctcgtggtggtcaccacgctgtgcgcgatcatcctcgggggcctcacctggatggacctgctgcgcgccctcatcatgctgggcgacaccatgtccgggcggatgggcgggcagatccacctggccatcatggccgtgttcaagatgagccccggctacgtgctcgggatcttcctgcgcaagctgacctcccgggagacggccctcatggtcatcggcatggcgatgaccaccgtgctggccatcccgcacgacctgatggagttcatcgacggcatcagcctcgggctgatcctgctcaagatggtgacccacttcgacaacacgcaggtcggcaccctggccctggccctcaccttcatcaagtccaccatgcccctggtgatggcctggcgcacgatcatggcggtgctgttcgtcgtgaccctcatccccctgtgccggaccagctgcctgcagaagcagtcccactgggtggagatcaccgccctcatcctgggggcccaggccctgcccgtctacctcatgacgctgatgaagggcgcgagcaagcgctcctggccgctgaacgaggggatcatggccgtgggcctcgtgagcctgctgggctccgccctcctgaagaacgacgtccccctggccgggcccatggtggccggcgggctcctgctggcggcctacgtgatgagcggctccagcgccgacctctccctggagaaggccgccaacgtccggtgggacgagatggcggacatcaccgggagctcccccatcatcgaggtgaagcaggacgaggacggcagcttcagcatccgcgacgtggaggagaccaacatgatcaccctgctcgtcaagctggccctgatcacggtgtccggcctctacccgctggccatccccgtgaccatgaccctgtggtacatgtggcaggtcaagacccagcggagcggggccctctgggacgtgccctcccccgccgcggcccagaaggccacgctgaccgagggcgtgtaccgcatcatgcagcgggggctgttcggcaagacccaggtcggggtgggcatccacaccgagggcgtgttccacaccatgtggcacgtcacgcgcgggagcgtgatctgccacgagtccggccggctcgagccgagctgggccgacgtgcgcaacgacatgatctcctacgggggcggctggcggctgggggacaagtgggacaaggaggaggacgtccaggtgctggccatcgagcccggcaagaaccccaagcacgtgcagaccaagcccgggctgttcaagaccctgaccggcgagatcggggcggtcacgctggacttcaagccgggcaccagcggctcccccatcatcaaccgcaaggggaaggtgatcggcctctacgggaacggcgtggtcaccaagagcggggactacgtgtccgccatcacccaggccgagcgcatcggcgagcccgactacgaggtggacgaggacatcttccggaagaagcgcctgacgatcatggacctgcacccgggcgccgggaagaccaagcggatcctgcccagcatcgtccgcgaggcgctcaagcggcgcctgcggaccctgatcctcgcccccacccgcgtggtggccgccgagatggaggaggccctgcggggcctgcccatccgctaccagacgccggcggtcaagtccgagcacaccgggcgggagatcgtggacctcatgtgccacgccaccttcaccacgcgcctgctgagctccacccgggtgcccaactacaacctcatcgtcatggacgaggcccacttcaccgaccccagctccgtggccgcccgcggctacatcagcacccgggtcgagatgggggaggcggccgccatcttcatgacggccacgcccccgggcaccaccgaccccttcccccagtccaacagccccatcgaggacatcgagcgcgagatcccggagcggagctggaacacgggcttcgactggatcaccgactaccaggggaagaccgtgtggttcgtgccctccatcaaggccggcaacgacatcgcgaactgcctgcgcaagagcgggaagaaggtcatccagctgtcccggaagaccttcgacacggagtaccccaagaccaagctcaccgactgggacttcgtggtgaccacggacatcagcgagatgggcgccaacttccgcgccgggcgcgtcatcgacccccggcgctgcctgaagccggtgatcctgaccgacggccccgagcgggtgatcctcgccggccccatccccgtcaccccggcgtccgccgcccagcgccgggggcgcatcggccggaaccccgcccaggaggacgaccagtacgtgttcagcggggaccccctgcgcaacgacgaggaccacgcccactggaccgaggcgaagatgctgctcgacaacatctacacgcccgagggcatcatcccgaccctgttcggccccgagcgggagaagacccaggccatcgacggggagttccgcctgcggggcgagcagcgcaagaccttcgtggagctcatgcggcgcggggacctgcccgtctggctgtcctacaaggtggccagcgccggcatctcctacaaggaccgggagtggtgcttcacgggggagcgcaacaaccagatcctcgaggagaacatggaggtggagatctggacccgggagggcgagaagaagaagctgcgccccaagtggctggacgcccgggtctacgcggacccgatggccctcaaggacttcaaggagttcgccagcggccgcaagtccatcaccctggacatcctgaccgagatcgccagcctccccacctacctgtccagccgggccaagctggcgctcgacaacatcgtgatgctgcacacgaccgagcgcgggggcaaggcctaccagcacgccctgaacgagctccccgagtccctggagaccctgatgctcgtggccctgctgggggcgatgaccgccggcatcttcctcttcttcatgcaggggaagggcatcggcaagctgagcatggggctgatcgccatcgccgtcgcctccggcctcctgtgggtggcggagatccagccgcagtggatcgccgccagcatcatcctggagttcttcctcatggtgctgctggtccccgagcccgagaagcagcgcacgccccaggacaaccagctcatctacgtgatcctgaccatcctgaccatcatcgccctcgtggccgcgaacgagatggggctgatcgagaagaccaagacggacttcggcttctaccaggtcaaggccgagaccaccatcctggacgtggacctccggccggcctccgcctggaccctgtacgccgtggcgacgaccatcctgacccccatgctccgccacaccatcgagaacacgagcgccaacctgagcctggccgccatcgccaaccaggcggccgtcctcatggggctgggcaagggctggcccctgcaccggatggacctcggggtgcccctgctggccatgggctgctactcccaggtgaacccgaccaccctcaccgccagcctggtcatgctgctcgtgcactacgcgatcatcgggcccggcctgcaggccaaggccacgcgcgaggcccagaagcggaccgccgcgggcatcatgaagaaccccaccgtggacgggatcaccgtcatcgacctggagcccatctcctacgacccgaagttcgagaagcagctcggccaggtgatgctgctggtgctctgcgccgggcagctgctgctcatgcgcacgacctgggccttctgcgaggtcctgaccctggccaccggccccatcctcacgctgtgggaggggaaccccggccggttctggaacaccaccatcgccgtgagcaccgcgaacatcttccgcggctcctacctggccggggccggcctcgccttcagcctgatcaagaacgcccagacgccccggcgcgggaccggcaccaccggggagacgctgggcgagaagtggaagcggcagctcaactccctggaccgcaaggagttcgaggagtacaagcggagcggcatcctggaggtggaccgcaccgaggcgaagtccgccctcaaggacgggagcaagatcaagtacgccgtctcccggggcaccagcaagatccgctggatcgtggagcgggggatggtgaagccgaagggcaaggtcgtggacctggggtgcggccgcggcgggtggtcctactacatggccaccctgaagaacgtgaccgaggtcaagggctacacgaagggcggccccgggcacgaggagcccatccccatggcgacctacggctggaacctcgtgaagctgcacagcggcgtggacgtcttctacaagccgaccgagcaggtcgacaccctgctctgcgacatcggggagtccagctccaaccccacgatcgaggagggccggaccctgcgcgtgctgaagatggtcgagccctggctgagctccaagcccgagttctgcatcaaggtgctcaacccgtacatgcccaccgtcatcgaggagctggagaagctgcagcgccggtacgggggcagcctcgtgcgctgccccctgagccggaactccacccacgagatgtactgggtgagcggcgtctccgggaacatcgtgagctccgtgaacacgaccagcaagatgctgctcaaccgcttcaccacccggcaccgcaagcccacgtacgagcgggacgccgacctgggcgccgggacccgctccgtcagcaccgagaccgagaagccggacatgacgatcatcggccggcgcctgcagcggctccaggaggagcacaaggagacctggcactacgaccacgagaacccctaccgcacctgggcctaccacgggtcctacgaggcccccagcaccggctccgcgagctccatggtgaacggcgtggtcaagctgctgacgaagccgtgggacgtggtgcccatggtcacccagctcgccatgaccgacaccacgcccttcgggcagcagcgggtgttcaaggagaaggtggacacccgcacgccccagccgaagcccggcacccgggtcgtgatgacgaccaccgccaactggctgtggaccctgctcgggcgcaagaagaacccccggctgtgcacgcgcgaggagttcatcagcaaggtgcggctgaacgccgccatcggcgcggtcttccaggaggagcaggggtggacctccgccagcgaggccgtgaacgactcccgcttctgggagctcgtggacaaggagcgggccctgcaccaggagggcaagtgcgagagctgcgtctacaacatgatgggcaagcgcgagaagaagctgggggagttcggccgcgccaaggggtcccgggcgatctggtacatgtggctcggcgcccgcttcctggagttcgaggccctggggttcctcaacgaggaccactggttcggccgggagaacagctggagcggcgtggagggggagggcctgcaccgcctggggtacatcctcgaggacatcgacaagaaggacggcgacctgatctacgccgacgacaccgcgggctgggacacccggatcacggaggacgacctgctcaacgaggagctgatcaccgagcagatggcgccccaccacaagatcctggccaaggccatcttcaagctcacctaccagaacaaggtggtcaaggtgctgcgcccgacccccaagggggccgtgatggacatcatctcccggaaggaccagcgcggcagcgggcaggtcggcacctacgggctgaacacgttcaccaacatggaggtgcagctcatccggcagatggaggcggagggcgtgatcacccgcgacgacatgcacaaccccaagggcctgaaggagcgggtcgagaagtggctgaaggagtgcggggtggaccgcctcaagcggatggccatctccggcgacgactgcgtggtcaagcccctggacgagcgcttcagcacctccctcctgttcctgaacgacatggggaaggtgcggaaggacatcccgcagtgggagcccagcaagggctggaagaactggcaggaggtgcccttctgctcccaccacttccacaagatcttcatgaaggacgggcgcagcctggtcgtgccctgccggaaccaggacgagctcatcggccgcgcccggatctcccagggcgccgggtggagcctgcgcgagacggcctgcctgggcaaggcgtacgcccagatgtggtccctcatgtacttccaccgccgggacctgcgcctggccagcatggccatctgctccgccgtgccgaccgagtggttccccaccagccggaccacgtggtccatccacgcgcaccaccagtggatgaccaccgaggacatgctcaaggtctggaaccgcgtgtggatcgaggacaaccccaacatgatcgacaagacccccgtgcacagctgggaggacatcccgtacctggggaagcgggaggacctgtggtgcggctccctcatcgggctgagcagccgcgccacgtgggccaagaacatccacaccgccatcacccaggtccggaacctgatcggcaaggaggagtacgtggactacatgcccgccatgcgccggtactccgcgcacttcgagagcgagggcgtgctctga

SEQ ID NO: 10481 - RNA, 9867 nt, synthetic construct
  misc_feature 1..9867: note = derived and/or modified CDS sequence (opt1) from DENV-4__JN638572__SS-prME
  source 1..9867: mol_type = other RNA
agcaccatcaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgacgagcgcctgggtgatgtacgggacctgcacccagtccggggagcggcgccgggagaagcgcagcgtggccctgaccccgcactccggcatgggcctcgagacgcgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtgttcttcatcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgacgaccatggcccagggcaagcccaccctggacttcgagctcatcaagaccacggccaaggaggtcgccctgctgcggacctactgcatcgaggcgtccatcagcaacatcaccaccgccacgcgctgcccgacccagggggagccctacctcaaggaggagcaggaccagcagtacatctgccggcgcgacatggtggaccggggctgggggaacggctgcggcctgttcgggaagggcggggtggtgacctgcgccaagttctcctgcctgggcaagatcaccgggaacctcgtgcagatcgagaacctggagtacacggtggtcgtgaccgtgcacaacggcgacacccacgccgtcggcaacgacaccagcaaccacggggtgacggccaccatcacgccccgctcccccagcgtcgaggtgaagctgccggagtacggcgagctcaccctggactgcgagccccggtccgggatcgacttcaacgagatgatcctgatgaagatgaagacgaagacctggctcgtgcacaagcagtggttcctggacctgcccctcccctggaccaccggcgcggacaccctggaggtccactggaaccacaaggagcgcatggtgacgttcaaggtgccgcacgccaagcggcaggacgtcaccgtgctggggagccaggagggcgccatgcactccgccctcgccggcgcgaccgaggtggacagcggggacggcaaccacatgttcgccgggcacctgaagtgcaaggtccgcatggagaagctgcgcatcaagggcatgagctacaccatgtgctccggcaagttcagcatcgacaaggagatggccgagacgcagcacgggaccaccgtggtgaaggtcaagtacgagggcaccggggccccctgcaaggtgcccatcgagatccgggacgtgaacaaggagaaggtcgtgggccgcatcatctccagcacgcccttcgccgagaacaccaactccgtgaccaacatcgagctcgagccgcccttcggggacagctacatcgtcatcggcgtgggcgacggggcgctgaccctgcactggttccggaagggctccagcatcgggaagatgttcgagtccacgtaccgcggcgccaagcggatggccatcctcggggagaccgcctgggacttcggcagcgtgggcgggctgctgacctccctcggcaaggcggtccaccaggtgttcgggagcgtgtacaccacgatgttcggcggggtctcctggatggtgcgcatcctgatcggcctgctggtgctctggatcggcaccaacagccggaacacctccatggccatgagctgcatcgccgtcgggggcatcaccctgttcctggggttcacggtgcacgccgacatgggctgcgtggtctcctggagcgggaaggagctcaagtgcggctccggcgtgttcgtgatcgacaacgtccacacctggaccgagcagtacaagttccagcccgagagccccgcccgcctggcgagcgccatcctgaacgcccacaaggagggggtgtgcggcatccggtccaccacgcgcctcgagaacgtgatgtggaagcagatcaccaacgagctgaactacgtcctgtgggagggcgggcacgacctcaccgtggtggccggcgacgtcaagggggtgctgagcaagggcaagcgggccctggcgccgcccgtgaacgacctcaagtactcctggaagacctgggggaaggccaagatcttcacgcccgagacccgcaacagcaccttcctggtcgacggccccgacacctccgagtgcccgaacgagcggcgcgcctggaacttcctggaggtggaggactacgggttcggcatgttcacgaccaacatctggatgaagttccgggagggcagctccgaggtgtgcgaccaccgcctcatgagcgccgccatcaaggaccagaaggcggtccacgccgacatggggtactggatcgagtccagcaagaaccagacctggcagatcgagaaggcctccctgatcgaggtgaagacctgcctgtggcccaagacgcacaccctctggagcaacggcgtgctggagtcccagatgctgatccccaaggcctacgcggggccgatcagccagcacaactaccggcagggctacgccacccagaccgccgggccctggcacctcggcaagctggagatcgacttcggcgagtgccccgggaccacggtcaccgtgcaggaggactgcgaccaccgcggcccctccctgcggaccaccacggccagcgggaagctcgtgacccagtggtgctgccgctcctgcaccatgccgcccctgcgcttcctgggcgaggacgggtgctggtacggcatggagatccggcccctcaacgagaaggaggagaacatggtcaagagccaggtgagcgccggccaggggacctccgagacgttcagcatgggcctgctgtgcctcaccctgttcgtcgaggagtgcctgcgccggcgcgtgacccggaagcacatgatcctcgtggtcgtgaccacgctgtgcgcgatcatcctcggcgggctcacctggatggacctgctgcgcgccctcatcatgctgggggacaccatgtccgggcggatgggcgggcagatccacctggccatcatggccgtgttcaagatgagccccggctacgtcctcgggatcttcctgcgcaagctgacctcccgggagacggccctcatggtgatcggcatggcgatgaccaccgtgctggccatcccgcacgacctgatggagttcatcgacggcatcagcctcgggctgatcctgctcaagatggtcacccacttcgacaacacccaggtcggcaccctggccctggccctcaccttcatcaagtccaccatgcccctggtgatggcctggcgcacgatcatggcggtcctgttcgtggtgaccctcatccccctgtgccggaccagctgcctgcagaagcagtcccactgggtcgagatcaccgccctcatcctgggggcccaggccctgcccgtgtacctcatgacgctgatgaagggcgcgagcaagcgctcctggccgctgaacgaggggatcatggccgtgggcctcgtcagcctgctgggctccgccctcctgaagaacgacgtgcccctggccgggcccatggtggccggcgggctcctgctggcggcctacgtcatgagcggctccagcgccgacctctccctggagaaggccgccaacgtgcggtgggacgagatggcggacatcaccgggagctcccccatcatcgaggtgaagcaggacgaggacggcagcttcagcatccgcgacgtcgaggagaccaacatgatcaccctgctcgtgaagctggccctgatcacggtgtccggcctctacccgctggccatccccgtcaccatgaccctgtggtacatgtggcaggtcaagacccagcggagcggggccctctgggacgtgccctcccccgccgcggcccagaaggccacgctgaccgagggcgtctaccgcatcatgcagcgggggctgttcggcaagacccaggtgggggtgggcatccacaccgagggcgtcttccacaccatgtggcacgtgacgcgcgggagcgtgatctgccacgagtccggccggctcgagccgagctgggccgacgtccgcaacgacatgatctcctacgggggcggctggcggctgggggacaagtgggacaaggaggaggacgtccaggtgctggccatcgagcccggcaagaaccccaagcacgtccagaccaagcccgggctgttcaagaccctgaccggcgagatcggggcggtgacgctggacttcaagccgggcaccagcggctcccccatcatcaaccgcaaggggaaggtgatcggcctctacgggaacggcgtcgtgaccaagagcggggactacgtgtccgccatcacccaggccgagcgcatcggcgagcccgactacgaggtcgacgaggacatcttccggaagaagcgcctgacgatcatggacctgcacccgggcgccgggaagaccaagcggatcctgcccagcatcgtgcgcgaggcgctcaagcggcgcctgcggaccctgatcctcgcccccacccgcgtggtcgccgccgagatggaggaggccctgcggggcctgcccatccgctaccagacgccggcggtgaagtccgagcacaccgggcgggagatcgtggacctcatgtgccacgccaccttcaccacgcgcctgctgagctccacccgggtccccaactacaacctcatcgtgatggacgaggcccacttcaccgaccccagctccgtcgccgcccgcggctacatcagcacccgggtggagatgggggaggcggccgccatcttcatgacggccacgcccccgggcaccaccgaccccttcccccagtccaacagccccatcgaggacatcgagcgcgagatcccggagcggagctggaacacgggcttcgactggatcaccgactaccaggggaagaccgtgtggttcgtcccctccatcaaggccggcaacgacatcgcgaactgcctgcgcaagagcgggaagaaggtgatccagctgtcccggaagaccttcgacacggagtaccccaagaccaagctcaccgactgggacttcgtggtcaccacggacatcagcgagatgggcgccaacttccgcgccgggcgcgtgatcgacccccggcgctgcctgaagccggtgatcctgaccgacggccccgagcgggtcatcctcgccggccccatccccgtgaccccggcgtccgccgcccagcgccgggggcgcatcggccggaaccccgcccaggaggacgaccagtacgtgttcagcggggaccccctgcgcaacgacgaggaccacgcccactggaccgaggcgaagatgctgctcgacaacatctacacgcccgagggcatcatcccgaccctgttcggccccgagcgggagaagacccaggccatcgacggggagttccgcctgcggggcgagcagcgcaagaccttcgtcgagctcatgcggcgcggggacctgcccgtgtggctgtcctacaaggtggccagcgccggcatctcctacaaggaccgggagtggtgcttcacgggggagcgcaacaaccagatcctcgaggagaacatggaggtcgagatctggacccgggagggcgagaagaagaagctgcgccccaagtggctggacgcccgggtgtacgcggacccgatggccctcaaggacttcaaggagttcgccagcggccgcaagtccatcaccctggacatcctgaccgagatcgccagcctccccacctacctgtccagccgggccaagctggcgctcgacaacatcgtgatgctgcacacgaccgagcgcgggggcaaggcctaccagcacgccctgaacgagctccccgagtccctggagaccctgatgctcgtcgccctgctgggggcgatgaccgccggcatcttcctcttcttcatgcaggggaagggcatcggcaagctgagcatggggctgatcgccatcgccgtggcctccggcctcctgtgggtggcggagatccagccgcagtggatcgccgccagcatcatcctggagttcttcctcatggtcctgctggtgcccgagcccgagaagcagcgcacgccccaggacaaccagctcatctacgtgatcctgaccatcctgaccatcatcgccctcgtcgccgcgaacgagatggggctgatcgagaagaccaagacggacttcggcttctaccaggtgaaggccgagaccaccatcctggacgtggacctccggccggcctccgcctggaccctgtacgccgtcgcgacgaccatcctgacccccatgctccgccacaccatcgagaacacgagcgccaacctgagcctggccgccatcgccaaccaggcggccgtgctcatggggctgggcaagggctggcccctgcaccggatggacctcggggtgcccctgctggccatgggctgctactcccaggtcaacccgaccaccctcaccgccagcctggtgatgctgctcgtgcactacgcgatcatcgggcccggcctgcaggccaaggccacgcgcgaggcccagaagcggaccgccgcgggcatcatgaagaaccccaccgtcgacgggatcaccgtgatcgacctggagcccatctcctacgacccgaagttcgagaagcagctcggccaggtgatgctgctggtcctctgcgtggggcagctgctgctcatgcgcacgacctgggccctgtgcgaggtgctgaccctcgccaccggccccatcatgacgctgtgggaggggaaccccggccggttctggaacaccaccatcgccgtcagcaccgccaacatcttccgcggctcctacctggcgggggccggcctcgccttcagcctgatcaagaacgcccagacgccccggcgcgggaccggcaccaccggggagacgctgggcgagaagtggaagcggcagctcaactccctggaccgcaaggagttcgaggagtacaagcggagcggcatcctggaggtggaccgcaccgaggccaagtccgcgctccgggacgggagcaagaccaagcacgccgtgtcccgcggcagctccaagatccggtggatcgtcgagcgcgggatgatcaagccgaagggcaaggtggtggacctggggtgcggccggggcgggtggagctactacatggccaccctgcagaacgtcaccgaggtgaagggctacacgaagggcggccccgggcacgaggagcccatccccatggccacctacggctggaacctcgtgaagctgcactccggcgtcgacgtgttctacaagccgaccgagcaggtcgacaccctgctctgcgacatcggggagagctccagcaaccccacgatcgaggagggccgcaccctgcgcgtcctgaagatggtggagccctggctgtccagcaagcccgagttctgcatcaaggtcctcaacccgtacatgcccaccgtgatcgaggagctggagaagctgcagcggcgctacgggggcagcctcgtgcggtgccccctgtcccgcaacagcacccacgagatgtactgggtctccggcgtgagcgggaacatcgtgtccagcgtcaacacgacctccaagatgctgctcaaccggttcaccacccgccaccggaagcccacgtacgagcgcgacgcggacctgggcgccgggacccggagcgtgtccaccgagaccgagaagccggacatgacgatcatcggccgccggctgcagcgcctccaggaggagcacaaggagacctggcactacgaccacgagaacccctaccggacctgggcctaccacgggagctacgaggccccctccaccggcagcgcctccagcatggtgaacggcgtcgtgaagctgctgacgaagccgtgggacgtggtccccatggtgacccagctcgcgatgaccgacaccacgcccttcgggcagcagcgcgtgttcaaggagaaggtcgacacccggacgccccagccgaagcccggcacccgcgtggtgatgacgaccaccgccaactggctgtggaccctgctcgggcggaagaagaacccccgcctgtgcacgcgggaggagttcatctccaaggtccgcagcaacgccgccatcggcgccgtgttccaggaggagcaggggtggacctccgcgagcgaggccgtgaacgactcccggttctgggagctggtcgacaaggagcgcgccctccaccaggagggcaagtgcgagagctgcgtgtacaacatgatgggcaagcgcgagaagaagctgggggagttcggccgggccaaggggagccgcgccatctggtacatgtggctgggcgcgcggttcctcgagttcgaggccctggggttcctgaacgaggaccactggttcggccgcgagaactcctggagcggcgtggagggggagggcctccaccggctggggtacatcctggaggacatcgacaagaaggacggcgacctcatctacgccgacgacaccgccggctgggacacccgcatcacggaggacgacctgctgaacgaggagctcatcaccgagcagatggcgccccaccacaaggtcctggccaaggccatcttcaagctgacctaccagaacaaggtggtgaaggtcctccggccgacccccaagggggccgtgatggacatcatctcccgcaaggaccagcggggcagcggccaggtgggcacctacgggctgaacacgttcaccaacatggaggtccagctgatccgccagatggaggccgagggcgtgatcacccgggacgacatgcacaaccccaagggcctcaaggagcgcgtggagaagtggctgaaggagtgcggggtcgaccggctgaagcgcatggcgatctccggcgacgactgcgtggtgaagcccctcgacgagcggttcagcacctccctgctgttcctcaacgacatggggaaggtccgcaaggacatcccgcagtgggagcccagcaagggctggaagaactggcaggaggtgcccttctgctcccaccacttccacaagatcttcatgaaggacgggcggagcctggtggtcccctgccgcaaccaggacgagctgatcggccgggcccgcatctcccagggcgccgggtggagcctccgcgagacggcctgcctgggcaaggcctacgcgcagatgtggtccctgatgtacttccaccggcgcgacctccggctggccagcatggccatctgctccgccgtgccgaccgagtggttccccaccagccgcaccacgtggtccatccacgcccaccaccagtggatgaccaccgaggacatgctgaaggtgtggaaccgggtctggatcgaggacaaccccaacatgaccgacaagacgcccgtgcacagctgggaggacatcccgtacctcgggaagcgcgaggacctgtggtgcggcagcctgatcgggctctccagccgggcgacctgggccaagaacatccacaccgccatcacccaggtgcgcaacctgatcggcaaggaggagtacatggactacatgcccgtcatgaagcggtactccgcccccagcgagtccgagggcgtgctgtga

SEQ ID NO: 10482 - RNA, 9867 nt, synthetic construct
  misc_feature 1..9867: note = derived and/or modified CDS sequence (opt1) from DENV-4__JX024757__SS-prME
  source 1..9867: mol_type = other RNA
agcaccatgaccctgctctgcctgatccccacggtgatggccttccacctgtccacccgcgacggcgagccgctcatgatcgtggccaagcacgagcgggggcgccccctgctgttcaagaccaccgagggcatcaacaagtgcacgctcatcgccatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggagcgccggcgcggacacctccgaggtgcactggaactacaaggagcgcatggtcaccttcaaggtgccgcacgccaagcggcaggacgtgacggtcctggggagccaggagggcgccatgcacagcgccctggccggcgcgaccgaggtggactccggggacggcaaccacatgttcgccgggcacctcaagtgcaaggtgcgcatggagaagctgcgcatcaagggcatgagctacaccatgtgctccggcaagttcagcatcgacaaggagatggccgagacccagcacgggacgaccgtcgtgaaggtgaagtacgagggcgccggggccccctgcaaggtccccatcgagatccgggacgtgaacaaggagaaggtggtcggccgcatcatctccagcacccccttcgcggagaacaccaactccgtgacgaacatcgagctggagccgcccttcggggacagctacatcgtgatcggcgtcggcgactccgccctcaccctgcactggttccggaaggggagctccatcggcaagatgttcgagagcacctaccgcggggccaagcggatggccatcctgggcgagaccgcgtgggacttcgggtccgtgggcggcctcttcacgagcctggggaaggccgtgcaccaggtcttcggctccgtgtacaccaccatgttcgggggcgtgagctggatgatccgcatcctgatcgggttcctcgtcctgtggatcggcaccaactcccggaacacgagcatggccatgacctgcatcgccgtgggcgggatcaccctgttcctgggcttcaccgtgcaggccgacatggggtgcgtcgtgtcctggaacggcaaggagctcaagtgcgggagcggcatcttcgtggtcgacaacgtgcacacgtggaccgagcagtacaagttccagcccgagagccccgcgcgcctggcctccgccatcctgaacgcccacaaggacggcgtgtgcgggatccggagcaccacccgcctcgagaacgtcatgtggaagcagatcacgaacgagctgaactacgtgctgtgggagggcgggcacgacctcaccgtggtcgccggcgacgtgaagggcgtgctgaccaaggggaagcgggcgctgaccccgcccgtcaacgacctcaagtactcctggaagacgtggggcaaggccaagatcttcacccccgaggcccgcaacagcaccttcctgatcgacgggcccgacacctccgagtgcccgaacggccggcgcgcctggaacttcctggaggtggaggactacgggttcggcatgttcacgaccaacatctggatgaagttccgggagggcagctccgaggtgtgcgaccaccgcctcatgagcgccgcgatcaaggaccagaaggccgtccacgccgacatggggtactggatcgagtccagcaagaaccagacctggcagatcgagaaggcctccctgatcgaggtgaagacctgcctgtggcccaagacgcacaccctctggagcaacggcgtgctggagtcccagatgctgatcccccggagctacgcggggccgttctcccagcacaactaccgccagggctacgccacccagaccgccgggccctggcacctcggcaagctggagatcgacttcggcgagtgccccgggaccacggtcaccatccaggaggactgcgaccaccggggccccagcctgcgcaccaccacggcctccgggaagctcgtgacccagtggtgctgccgcagctgcaccatgccgcccctgcggttcctgggcgaggacgggtgctggtacggcatggagatccgccccctcagcgagaaggaggagaacatggtgaagtcccaggtcaccgccggccaggggacgagcgagaccttctccatgggcctgctgtgcctcaccctgttcgtggaggagtgcctgcggcgccgggtcacccgcaagtacatgatgctcgtggtggtcatcacgttctgcgcgatcatcctcggcgggctgacctggatggacctcctgcgggccctgatcatgctcggggacaccatgagcgggcgcatcggcgggcagatccacctggccatcatggccgtgttcaagatgtcccccggctacgtgctgggggtcttcctccggaagctgaccagccgcgagacggccctgatggtgatcggcatggcgatgaccaccgtgttctccatcccgcacgacctcatggagctgatcgacggcatcagcctggggctcatcctgctgcggatcgtcacccacttcgacaacacccaggtgggcaccctcgccctgtccctgaccttcatccgcagcaccacgcccctcgtgatggcctggcggaccatcatggccgtcttcttcgtggtgaccctgatccccctgtgccgcacctcctgcctccagaagcagagccactgggtcgagatcacggccctgatcctgggggcgcaggccctccccgtgtacctgatgaccctgatgaagggcgcctcccggcgcagctggccgctcaacgaggggatcatggccgtgggcctggtctccctgctcggcagcgcgctgctgaagaacgacgtgcccctcgccgggcccatggtggccggcgggctgctgctcgccgcctacgtcatgtccggcagctccgcggacctgagcctggagaaggccgccaacgtgcagtgggacgagatggccgacatcaccgggagctcccccatcatcgaggtgaagcaggacgaggacggcagcttctccatccgggacgtcgaggagaccaacatgatcacgctcctggtgaagctggccctcatcaccgtgagcggcctgtacccgctggcgatccccgtcaccatggccctctggtacatctggcaggtcaagacccagcgctccggggccctgtgggacgtgcccagccccgccgccacgcagaaggcgaccctgtccgagggcgtctaccggatcatgcagcgcgggctgttcggcaagacccaggtgggggtgggcatccacatggagggcgtcttccacaccatgtggcacgtgacccgggggagcgtgatctgccacgagacgggccgcctggagccgtcctgggccgacgtccgcaacgacatgatcagctacgggggcggctggcggctgggggacaagtgggacaaggaggaggacgtccaggtgctcgccatcgagcccggcaagaaccccaagcacgtccagaccaagcccgggctgttcaagaccctgaccggcgagatcggggccgtgacgctcgacttcaagccgggcacctccggcagccccatcatcaacaagaaggggaaggtgatcggcctgtacgggaacggcgtcgtgaccaagtccggggactacgtgagcgccatcacccaggcggagcgcatcggcgagcccgactacgaggtcgacgaggacatcttccggaagaagcgcctgacgatcatggacctccacccgggcgccgggaagaccaagcggatcctgccctccatcgtgcgcgaggccctgaagcggcgcctccggaccctgatcctggcccccacccgcgtggtcgcggccgagatggaggaggccctgcggggcctccccatccgctaccagacgccggccgtgaagtccgagcacaccgggcgggagatcgtggacctgatgtgccacgccaccttcaccacgcgcctgctctccagcacccgggtccccaactacaacctgatcgtgatggacgaggcgcacttcaccgacccctgctccgtcgccgcccgcggctacatcagcacccgggtggagatgggggaggccgccgcgatcttcatgacggccacgcccccgggcagcatcgaccccttcccccagtccaacagccccatcgaggacatcgagcgcgagatcccggagcggtcctggaacaccggcttcgactggatcaccgactaccaggggaagacggtgtggttcgtccccagcatcaaggccggcaacgacatcgccaactgcctgcgcaagtccgggaagcgcgtgatccagctcagccggaagaccttcgacaccgagtaccccaagaccaagctgacggactgggacttcgtggtcaccaccgacatctccgagatgggcgccaacttccgcgcggggcgggtgatcgacccccgccggtgcctgaagccggtgatcctcaccgacggccccgagcgcgtcatcctggccggccccatccccgtgacgccggccagcgccgcgcagcggcgcgggcggatcggccgcaaccccgcccaggaggacgaccagtacgtgttctccggggaccccctgaagaacgacgaggaccacgcccactggaccgaggccaagatgctcctggacaacatctacacccccgagggcatcatcccgaccctgttcggccccgagcgggagaagacgcaggccatcgacggggagttccgcctccggggcgagcagcgcaagaccttcgtcgagctgatgcggcgcggggacctgcccgtgtggctcagctacaaggtggcgtccgccggcatcagctacaaggaccgggagtggtgcttcaccggggagcgcaacaaccagatcctggaggagaacatggaggtcgagatctggacccgggagggcgagaagaagaagctgcgccccaagtggctcgacgcccgggtgtacgccgacccgatggccctgaaggacttcaaggagttcgcgtccggccgcaagagcatcacgctggacatcctcaccgagatcgccaccctgcccacctacctgtccagcaaggccaagctcgccctggacaacatcgtgatgctgcacaccacggagaagggcggccgcgcctaccagcacgcgctcaacgagctgcccgagtccctggagaccctcatgctggtcgccctgctcggggccctgaccgccggcatcttcctgttcttcatgcaggggaagggcatcggcaagctcagcatggggctgatcgcgatcgccgtggcctccggcctgctctgggtggccgagatccagccgcagtggatcgccgcgagcatcatcctggagttcttcctgatggtcctcctgatccccgagcccgagaagcagcggacgccccaggacaaccagctgatctacgtgatcctcacgatcctgaccatcatcgggctgatcgccgccaacgagatgggcctcatcgagaagaccaagaccgacttcgggttctaccaggtgaagacggagaccaccatcctggacgtcgacctgcgcccggccagcgcctggaccctctacgcggtggccacgaccatcctgacccccatgctgcggcacaccatcgagaacacgtccgccaacctcagcctggccgccatcgcgaaccaggccgccgtgctgatgggcctcggcaaggggtggcccctgcaccgcatggacctgggcgtccccctcctggccatggggtgctactcccaggtgaacccgaccaccctgaccgccagcctcgtgatgctgctggtccactacgcgatcatcggccccggcctccaggccaaggccacgcgggaggcccagaagcgcaccgcggccgggatcatgaagaaccccaccgtggacggcatcaccgtgatcgacctggagcccatctcctacgacccgaagttcgagaagcagctggggcaggtcatgctcctggtgctgtgcgtgggccagctcctgctgatgcggacgacctgggccctctgcgaggtcctgaccctggccaccgggcccatcatgacgctctgggagggcaaccccggccgcttctggaacaccaccatcgccgtgagcaccgcgaacatcttccgggggtcctacctggccggcgccgggctggccttcagcctcatcaagaacgcccagacgccccgccggggcaccgggaccaccggcgagacgctgggcgagaagtggaagcgccagctgaactccctcgaccggaaggagttcgaggagtacaagcgcagcgggatcctggaggtggaccggaccgaggcgaagtccgccctgcgcgacggcagcaagatcaagcacgccgtctcccgggggagctccaagatccgctggatcgtggagcggggcatgatcaagccgaaggggaaggtggtcgacctcggctgcggccgcgggggctggagctactacatggccaccctgaagaacgtgaccgaggtgaaggggtacaccaagggcgggcccggccacgaggagcccatccccatggccacgtacggctggaacctggtcaagctccactccggggtggacgtgttctacaagccgaccgagcaggtcgacaccctgctgtgcgacatcggcgagagctccagcaaccccaccatcgaggaggggcgcacgctccgggtgctgaagatggtggagccctggctgagctccaagcccgagttctgcatcaaggtcctcaacccgtacatgcccaccgtgatcgaggagctggagaagctgcagcgccggcacggcggcagcctggtccgctgccccctctcccggaacagcacccacgagatgtactgggtgtccggggcgagcggcaacatcgtgtccagcgtcaacaccatctccaagatgctgctgaaccgcttcacgacccggcaccgcaagcccacctacgagaaggacgtggacctcggggccggcacccggagcgtgtccacggagaccgagaagccggacatgaccatcatcgggcgccggctgcagcgcctgcgggaggagcacaaggagacctggcactacgaccaggagaacccctaccgcacgtgggcctaccacggcagctacgaggccccctccaccggcagcgcgtccagcatggtcaacggggtggtgaagctcctgaccaagccgtgggacgtcatccccatggtgacccagctggccatgacggacaccacccccttcggccagcagcgggtgttcaaggagaaggtcgacacccgcacgccccagccgaagcccgggacccggatgatcatgaccatgaccgccaactggctctgggccctgctgggcaagaagaagtccccgcgcctctgcacgcgggaggagttcatcagcaaggtgcgcagcaacgccgcgatcggggccgtgttccaggaggagcagggctggaccagcgccagcgaggccgtcaacgactcccggttctgggagctggtggacaaggagcgcgccctgcaccaggagggcaagtgcgagagctgcgtgtacaacatgatggggaagcgcgagaagaagctcggcgagttcgggcgggcgaagggctcccgcgccatctggtacatgtggctgggggcccggttcctggagttcgaggccctcggcttcctgaacgaggaccactggttcagccgcgagaactcctggagcggcgtcgagggggagggcctgcaccggctcgggtacatcctggaggacatcgacaagaaggacggcgacctgatctacgccgacgacaccgcgggctgggacacccgcatcacggaggacgacctcctgaacgaggagctgatcaccgagcagatggcgccccaccacaagaccctcgccaaggccatcttcaagctgacctaccagaacaaggtggtgaaggtcctgcggcccacgcccaagggggcggtgatggacatcatctcccgcaaggaccagcggggcagcggccaggtgggcacctacgggctcaacaccttcaccaacatggaggtccagctgatccgccagatggaggccgagggcgtgatcacccaggacgacatgcagaacccccggggcctgaaggagcgcgtggagaagtggctcaaggagtgcggggtcgaccggctgaagcgcatggccatctccggcgacgactgcgtggtgaagcccatcgacgagcggttcagcacgtccctcctgttcctgaacgacatggggaaggtccgcaaggacatcccgcagtgggagcccagcaagggctggaagaactggcaggaggtgcccttctgctcccaccacttccacaagatcttcatgaaggacgggcggagcctggtggtcccctgccgcaaccaggacgagctcatcggccgggcccgcatctcccagggcgccgggtggagcctgcgcgagaccgcgtgcctgggcaaggcctacgcccagatgtggtccctcatgtacttccaccggcgcgacctgcggctggccagcatggccatctgcagcgcggtgccgaccgagtggttccccacctcccgcacgacctggagcatccacgcccaccaccagtggatgaccaccgaggacatgctcaaggtgtggaaccgggtctggatcgaggacaaccccaacatgacggacaagacccccgtgcactcctgggaggacatcccgtacctggggaagcgcgaggacctgtggtgcggcagcctcatcgggctgtccagccgggccacctgggccaagaacatccacaccgccatcacccaggtgcgcaacctgatcggcaaggaggagtacgtcgactacatgcccgcgatgaagcggtactccgcccccttcgagagcgagggcgtgctctga

SEQ ID NO: 10483 - RNA, 9867 nt, synthetic construct
  misc_feature 1..9867: note = derived and/or modified CDS sequence (opt1) from DENV-4__JF741967__SS-prME
  source 1..9867: mol_type = other RNA
agcaccatgaccctgctctgcctgatccccaccgtgatggccttccacctgtccacccgggacggcgagccgctcatgatcgtggccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgaccagcacctgggtcatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcaacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatcagctccacccccttcgcggagaacacgaacagcgtgaccaacatcgagctggagccgcccttcggggactcctacatcgtgatcggcgtcggcgacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtgcaccaggtcttcggcagcgtgtacaccaccatgttcgggggcgtgtcctggatgatccgcatcctgatcgggttcctcgtcctgtggatcggcacgaacagccggaacacctccatggccatgacctgcatcgccgtgggcgggatcaccctgttcctgggcttcacggtgcaggccgacatggggtgcgtcgtgagctggaacggcaaggagctcaagtgcgggtccggcatcttcgtggtcgacaacgtgcacacctggaccgagcagtacaagttccagcccgagagccccgcgcgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgccggcgacgtgaagggcgtgctgaccaaggggaagcgggcgctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctcatcgaggtgaagacgtgcctgtggcccaagacccacaccctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcacgaccgtcaccatccaggaggactgcgaccaccgggggccctccctgcgcaccacgaccgccagcggcaagctggtgacccagtggtgctgccgctcctgcaccatgccgcccctccggttcctgggggaggacggctgctggtacgggatggagatccgccccctgagcgagaaggaggagaacatggtgaagtcccaggtcacggccggccagggcacctccgagaccttcagcatggggctcctgtgcctgaccctcttcgtggaggagtgcctgcggcgccgggtcacgcgcaagcacatgatcctggcggtggtgatcaccttctgcgccatcatcctcggcgggctgacctggatggacctgctccgggtcctgatcatgctgggcgacaccatgtccggccgcatcgggggccagatccacctcgccatcatggccgtgttcaagatgagccccgggtacgtgctgggcgtcttcctgcggaagctcacgtcccgcgagaccgccctgatggtgatcgggatggcgatgaccaccgtgttcagcatcccgcacgacctgatggagctcatcgacggcatctccctgggcctgatcctcctgaagatcgtcacgcacttcgacaacacccaggtggggaccctggccctcagcctgaccttcatccggtccacgacgcccctggtgatggcctggcgcaccatcatggccgtcttcttcgtggtgaccctcatccccctgtgccggacgagctgcctgcagaagcagtcccactgggtcgagatcaccgccctcatcctgggcgcgcaggccctgcccgtgtacctcatgaccctgatgaagggggccagccgccggtcctggccgctgaacgagggcatcatggccgtggggctcgtcagcctgctgggctccgcgctcctgaagaacgacgtgcccctggccggccccatggtggccgggggcctcctgctggccgcctacgtcatgagcgggtccagcgcggacctctccctggagaaggccgccaacgtgcagtgggacgagatggccgacatcaccggcagcagccccatcatcgaggtgaagcaggacgaggacgggtccttcagcatccgcgaggtcgaggagacgaacatgatcaccctgctcgtgaagctggccctgatcaccgtgtccggcctctacccgctggcgatccccgtcaccatggccctgtggtacgtgtggcaggtcaagacgcagcggagcggcgccctctgggacgtcccctcccccgccgccacccacaaggcgaccctgagcgagggggtgtaccgcatcatgcagcggggcctgttcgggaagacccaggtgggcgtcgggatccacatggagggcgtgttccacaccgtgggccacgtcacgcgcgggtccgtgatctgccacgagaccggccggctcgagccgagctggggcgacgtgcgcaacgacatgatctcctacggcggcgggtggcgcctgggcgacaagtgggacaaggaggaggacgtccaggtgctggccatcgagcccgggaagaaccccaagcacgtgcagaccaagcccggcctcttcaagaccctgacgggggagatcggcgccgtcaccctggacttcaagccgggcaccagcgggtcccccatcatcaacaagaagggcaaggtgatcgggctctacggcaacggggtggtcaccaagagcggcgactacgtgtccgccatcacgcaggccgagcggatcggcgagcccgactacgaggtggacgaggacatcttccgcaagaagcggctgaccatcatggacctgcacccgggggcgggcaagaccaagcgcatcctccccagcatcgtccgggaggccctgaagcgccggctgcgcaccctcatcctggcccccacgcgggtggtggccgcggagatggaggaggccctgcgcgggctgcccatccggtaccagaccccggccgtcaagtccgagcacaccggccgcgagatcgtggacctcatgtgccacgccaccttcacgacccggctgctgagctccacccgcgtccccaactacaacctcatcgtgatggacgaggcccacttcaccgacccctgcagcgtggcggcccgggggtacatctccacgcgcgtcgagatgggcgaggccgccgccatcttcatgaccgcgacgcccccgggcagcatcgaccccttcccccagagcaactcccccatcgaggacatcgagcgggagatcccggagcgcagctggaacaccgggttcgactggatcacggactaccagggcaagaccgtgtggttcgtgccctccatcaaggccgggaacgacatcgccaactgcctgcgcaagagcggcaagcgcgtcatccagctgtcccgcaagaccttcgacaccgagtaccccaagacgaagctcaccgactgggacttcgtggtgaccaccgacatcagcgagatgggggccaacttccgggccggccgcgtcatcgacccccggcgctgcctgaagccggtgatcctgacggacggccccgagcgggtgatcctcgcggggcccatccccgtcaccccggcctccgccgcccagcgccggggccgcatcgggcggaaccccgcgcaggaggacgaccagtacgtgttcagcggcgaccccctgaagaacgacgaggaccacgcccactggaccgaggccaagatgctgctcgacaacatctacacccccgagggcatcatcccgacgctgttcgggcccgagcgcgagaagacccaggccatcgacggcgagttccggctgcgcggggagcagcggaagaccttcgtggagctcatgcgccggggcgacctgcccgtctggctgtcctacaaggtggccagcgcggggatctcctacaaggaccgcgagtggtgcttcaccggcgagcggaacaaccagatcctcgaggagaacatggaggtggagatctggacgcgcgagggcgagaagaagaagctgcggcccaagtggctggacgcccgcgtctacgccgacccgatggccctcaaggacttcaaggagttcgccagcgggcggaagtccatcaccctggacatcctgaccgagatcgcgaccctccccacctacctgagctccaaggccaagctggccctcgacaacatcgtgatgctgcacacgaccgagaagggcgggcgcgcctaccagcacgccctgaacgagctccccgagagcctggagaccctgatgctcgtggcgctgctgggcgccatgaccgccgggatcttcctcttcttcatgcagggcaagggcatcgggaagctgtccatgggcctgatcgccatcgcggtcgccagcgggctcctgtgggtggccgagatccagccgcagtggatcgccgcctccatcatcctggagttcttcctcatggtgctgctgatccccgagcccgagaagcagcgcacgccccaggacaaccagctcatctacgtcatcctgaccatcctgaccatcatcggcctcatcgcggccaacgagatggggctgatcgagaagaccaagacggacttcggcttctaccaggtgaagccggagaccaccatcctggacgtggacctccggcccgccagcgcctggaccctgtacgccgtcgcgacgaccatcctgacccccatgctccgccacaccatcgagaacacgagcgccaacctgtccctggccgccatcgccaaccaggcggccgtgctcatgggcctggggaagggctggcccctgcaccggatggacctcggggtgccgctgctggccatgggctgctacagccaggtcaaccccaccaccctcaccgcctccctggtgatgctgctcgtgcactacgccatcatcggccccgggctgcaggcgaaggccacgcgcgaggcccagaagcggaccgccgcgggcatcatgaagaaccccaccgtcgacgggatcaccgtgatcgacctggagccgatcagctacgaccccaagttcgagaagcagctcggccaggtgatgctgctggtcctctgcgtggggcagctgctgctcatgcgcacgacctgggccctgtgcgaggtgctgaccctcgccaccggccccgtcatgacgctgtgggagggcaaccccgggcggttctggaacaccaccatcgccgtgtccaccgccaacatcttccgcggcagctacctggcgggggccggcctcgccttctccctgatcaagaacgcccagacgccgcggcgcgggaccggcaccaccggcgagacgctgggggagaagtggaagcggcagctcaacagcctggaccgcaaggagttcgaggagtacaagcggtccggcatcctggaggtggaccgcaccgaggccaagagcgcgctccgggacgggaccaagatcaagtacgccgtctcccgcggcagctccaagatccggtggatcgtggagcgcgggatgatcaagcccaagggcaaggtggtcgacctgggctgcgggcggggcgggtggagctactacatggccaccctgaagaacgtgaccgaggtgaagggctacacgaagggcgggcccggccacgaggagcccatcccgatggccacctacgggtggaacctcgtcaagctgcactccggcgtggacgtgttctacaagcccaccgagcaggtcgacaccctgctctgcgacatcggggagagctccagcaaccccacgatcgaggagggccgcaccctgcgcgtgctgaagatggtcgagccctggctctccagcaagccggagttctgcatcaaggtgctgaacccctacatgcccaccgtgatcgaggagctggagaagctccagcggcgccacggcgggagcctggtccggtgccccctgtcccgcaacagcacccacgagatgtactgggtgtccggcgccagcgggaacatcgtgtccagcgtcaacacgatctccaagatgctgctcaaccggttcaccacccgccaccggaagccgacctacgagaaggacgtggacctgggcgcggggacgcgcagcgtgtccaccgagaccgagaagcccgacatgaccgtcatcggccggcgcctgcagcggctccgcgaggagcacaaggagacgtggcactacgaccaggagaacccctaccggacctgggcctaccacggcagctacgaggccccgtccaccgggagcgcctccagcatggtgaacggcgtggtcaagctgctgaccaagccctgggacgtgatccccatggtgacgcagctcgcgatgaccgacaccacccccttcgggcagcagcgcgtcttcaaggagaaggtggacacgcggaccccgcagcccaagcccggcacccgcatgatcatgaccacgaccgccaactggctgtgggccctgctcgggaagaagaagtccccgcggctgtgcacccgcgaggagttcatcagcaaggtgcggagcaacgccgccatcggcgcggtcttccaggaggagcagggctggaccagcgcctccgaggccgtgaacgacagccgcttctgggagctggtggacaaggagcgggccctccaccaggaggggaagtgcgagagctgcgtctacaacatgatgggcaagcgcgagaagaagctgggggagttcggccgcgccaaggggtcccgggcgatctggtacatgtggctgggcgcccgcttcctcgagttcgaggccctgggcttcctgaacgaggaccactggttcagccgggagaactcctggagcggggtggagggcgaggggctccaccgcctgggctacatcctggaggacatcgacaagaaggacggcgacctcatctacgccgacgacacggccgggtgggacacccggatcaccgaggacgacctgctgaacgaggagctcatcaccgagcagatggcgccccaccacaagacgctggccaaggccatcttcaagctgacctaccagaacaaggtggtcaaggtgctccgccccacccccaagggcgccgtgatggacatcatctcccggaaggaccagcgcgggagcggccaggtcgggacctacggcctgaacaccttcacgaacatggaggtgcagctgatccggcagatggaggcggagggcgtgatcacccaggacgacatgcagaaccccaaggggctcaaggagcgcgtcgagaagtggctgaaggagtgcggcgtggaccggctgaagcgcatggccatctccggggacgactgcgtggtcaagccgctcgacgagcggttcagcacctccctgctgttcctcaacgacatgggcaaggtgcgcaaggacatcccccagtgggagcccagcaaggggtggaagaactggcaggaggtgcccttctgctcccaccacttccacaagatcttcatgaaggacggccggagcctggtcgtgccgtgccgcaaccaggacgagctgatcggccgggcccgcatctcccagggggccggctggagcctccgggagaccgcctgcctggggaaggcgtacgcccagatgtggtccctgatgtacttccaccgccgcgacctccggctggccagcatggccatctgctccgccgtgcccacggagtggttccccaccagccgcaccacctggagcatccacgcgcaccaccagtggatgacgaccgaggacatgctgaaggtctggaaccgggtgtggatcgaggacaaccccaacatgaccgacaagaccccggtgcactcctgggaggacatcccctacctcggcaagcgcgaggacctgtggtgcgggagcctgatcggcctctccagccgggccacgtgggccaagaacatccacaccgccatcacccaggtccgcaacctgatcggcaaggaggagtacgtggactacatgcccgccatgaagcggtactccgcgcccttcgagagcgagggggtgctgtga

SEQ ID NO: 10484 - RNA, 9867 nt, synthetic construct
  misc_feature 1..9867: note = derived and/or modified CDS sequence (opt1) from DENV-4__JQ822247__SS-prME
  source 1..9867: mol_type = other RNA
agcaccatgaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcaacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatcagctccacccccttcgcggagaacacgaacagcgtgaccaacatcgagctggagccgcccttcggggactcctacatcgtgatcggcgtcggcgacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtgcaccaggtcttcggcagcgtgtacaccaccatgttcgggggcgtgtcctggatgatccgcatcctgatcgggttcctcgtcctgtggatcggcacgaacagccggaacacctccatggccatgacctgcatcgccgtgggcgggatcaccctgttcctgggcttcacggtgcaggccgacatggggtgcgtcgtgagctggaacggcaaggagctcaagtgcgggtccggcatcttcgtggtcgacaacgtgcacacctggaccgagcagtacaagttccagcccgagagccccgcgcgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgccggcgacgtgaagggcgtgctgaccaaggggaagcgggcgctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctcatcgaggtgaagacgtgcctgtggcccaagacccacaccctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcacgaccgtcaccatccaggaggactgcgaccaccgggggccctccctgcgcaccacgaccgccagcggcaagctggtgacccagtggtgctgccgctcctgcaccatgccgcccctccggttcctgggggaggacggctgctggtacgggatggagatccgccccctgagcgagaaggaggagaacatggtgaagagccaggtcacggccggccagggcacctccgagaccttcagcatggggctcctgtgcctgaccctcttcgtggaggagtgcctgcggcgccgggtcacgcgcaagcacatgatcctggcggtggtgatcaccttctgcgccatcatcctcggcgggctgacctggatggacctgctccgggtcctgatcatgctgggcgacaccatgtccggccgcatcgggggccagatccacctcgccatcatggccgtgttcaagatgagccccgggtacgtgctgggcgtcttcctgcggaagctcacgtcccgcgagaccgccctgatggtgatcgggatggcgatgaccaccgtgttcagcatcccgcacgacctgatggagctcatcgacggcatctccctgggcctgatcctcctgaagatcgtcacgcacttcgacaacacccaggtggggaccctggccctcagcctgaccttcatccggtccacgacccccctggtgatggcctggcgcaccatcatggccgtcttcttcgtggtgaccctcatccccctgtgccggacgagctgcctgcagaagcagtcccactgggtcgagatcaccgccctcatcctgggcgcgcaggccctgcccgtgtacctcatgaccctgatgaagggggccagccgccggtcctggccgctgaacgagggcatcatggccgtggggctcgtcagcctgctgggctccgcgctcctgaagaacgacgtgcccctggccggccccatggtggccgggggcctcctgctggccgcctacgtcatgagcgggtccagcgcggacctctccctggagaaggccgccaacgtgcagtgggacgagatggccgacatcaccggcagcagccccatcatcgaggtgaagcaggacgaggacgggtccttcagcatccgcgacgtcgaggagacgaacatgatcaccctgctcgtgaagctggccctgatcaccgtgtccggcctctacccgctggcgatccccgtcaccatggccctgtggtacgtgtggcaggtgaagacgcagcggagcggcgccctctgggacgtcccctcccccgccgccacccagaaggcgaccctgagcgagggggtgtaccgcatcatgcagcggggcctgttcgggaagacccaggtgggcgtcgggatccacatggagggcgtgttccacaccatgtggcacgtgacgcgcggctccgtcatctgccacgagaccgggcggctcgagccgagctgggccgacgtgcgcaacgacatgatctcctacggcgggggctggcgcctgggcgacaagtgggacaaggaggaggacgtgcaggtcctggccatcgagcccgggaagaaccccaagcacgtgcagaccaagcccggcctcttcaagaccctgacgggggagatcggcgccgtgaccctggacttcaagccggggaccagcggctcccccatcatcaacaagaagggcaaggtcatcgggctctacggcaacggggtggtgaccaagagcggcgactacgtctccgccatcacgcaggcggagcggatcggggagcccgactacgaggtggacgaggacatcttccgcaagaagcggctgaccatcatggacctgcacccgggcgccggcaagaccaagcgcatcctccccagcatcgtgcgggaggccctgaagcgccggctgcgcaccctcatcctggcccccacgcgggtcgtggcggccgagatggaggaggccctgcgcgggctgcccatccggtaccagaccccggccgtgaagtccgagcacaccggccgcgagatcgtcgacctcatgtgccacgccaccttcacgacccggctgctgagctccacccgcgtgcccaactacaacctcatcgtcatggacgaggcgcacttcaccgacccctgcagcgtggccgcccgggggtacatctccacgcgcgtggagatgggcgaggccgccgcgatcttcatgaccgccacccccccggggagcatcgaccccttcccccagagcaactcccccatcgaggacatcgagcgggagatcccggagcgcagctggaacaccggcttcgactggatcacggactaccagggcaagaccgtctggttcgtgccctccatcaaggccgggaacgacatcgccaactgcctgcggaagagcggcaagcgcgtgatccagctgtcccgcaagaccttcgacaccgagtaccccaagacgaagctcaccgactgggacttcgtcgtgaccaccgacatcagcgagatgggggccaacttccgggcgggccgcgtgatcgacccccggcgctgcctgaagccggtcatcctgacggacgggcccgagcgggtgatcctcgccggccccatccccgtgaccccggcctccgccgcgcagcgccggggccgcatcgggcggaaccccgcccaggaggacgaccagtacgtcttcagcggcgaccccctgaagaacgacgaggaccacgcccactggaccgaggccaagatgctgctcgacaacatctacacccccgaggggatcatcccgacgctgttcggccccgagcgcgagaagacccaggccatcgacggcgagttccggctgcgcggggagcagcggaagaccttcgtggagctcatgcgccggggcgacctgcccgtgtggctgtcctacaaggtcgcgagcgccgggatctcctacaaggaccgcgagtggtgcttcaccggcgagcggaacaaccagatcctcgaggagaacatggaggtggagatctggacgcgcgagggggagaagaagaagctgcggcccaagtggctggacgcccgcgtgtacgccgacccgatggccctcaaggacttcaaggagttcgcgagcggccggaagtccatcaccctggacatcctgaccgagatcgccaccctccccacctacctgagctccaaggccaagctggccctcgacaacatcgtcatgctgcacacgaccgagaagggcgggcgcgcctaccagcacgcgctgaacgagctccccgagagcctggagaccctgatgctcgtggccctgctgggcgccatgaccgccgggatcttcctcttcttcatgcagggcaaggggatcggcaagctgtccatgggcctgatcgcgatcgccgtggccagcgggctcctgtgggtcgccgagatccagccgcagtggatcgccgcgtccatcatcctggagttcttcctcatggtgctgctgatccccgagcccgagaagcagcgcacgccccaggacaaccagctcatctacgtgatcctgaccatcctgaccatcatcggcctcatcgccgccaacgagatggggctgatcgagaagaccaagacggacttcggcttctaccaggtcaagccggagaccaccatcctggacgtggacctccggcccgccagcgcctggaccctgtacgcggtggccacgaccatcctgacccccatgctccgccacaccatcgagaacacgagcgccaacctgtccctggccgccatcgcgaaccaggccgccgtcctcatggggctgggcaagggctggcccctgcaccggatggacctcggggtgccgctgctggccatgggctgctacagccaggtgaaccccaccaccctcaccgcctccctggtcatgctgctcgtgcactacgcgatcatcgggcccggcctgcaggccaaggccacgcgcgaggcccagaagcggaccgcggccggcatcatgaagaaccccaccgtggacgggatcaccgtcatcgacctggagccgatcagctacgaccccaagttcgagaagcagctcggccaggtgatgctgctggtgctctgcgtcgggcagctgctgctcatgcgcacgacctgggccctgtgcgaggtgctgaccctcgccaccggccccgtgatgacgctgtgggaggggaaccccggccggttctggaacaccaccatcgccgtctccaccgcgaacatcttccgcggcagctacctggccggggccggcctcgccttctccctgatcaagaacgcccagacgccgcggcgcgggaccggcaccaccggggagacgctgggcgagaagtggaagcggcagctcaacagcctggaccgcaaggagttcgaggagtacaagcggtccggcatcctggaggtggaccgcaccgaggcgaagagcgccctccgggacgggaccaagatcaagtacgccgtgtcccgcggcagctccaagatccggtggatcgtcgagcgcgggatgatcaagcccaagggcaaggtggtggacctggggtgcggccggggcgggtggagctactacatggccaccctgaagaacgtcaccgaggtgaagggctacacgaaggggggccccgggcacgaggagcccatcccgatggccacctacggctggaacctcgtgaagctgcactccggcgtcgacgtgttctacaagcccaccgagcaggtggacaccctgctctgcgacatcggggagagctccagcaaccccacgatcgaggagggccgcaccctgcgcgtcctgaagatggtggagccctggctctccagcaagccggagttctgcatcaaggtcctgaacccctacatgcccaccgtgatcgaggagctggagaagctccagcggcgccacgggggcagcctggtgcggtgccccctgtcccgcaacagcacccacgagatgtactgggtctccggcgcgagcgggaacatcgtgtccagcgtgaacacgatctccaagatgctgctcaaccggttcaccacccgccaccggaagccgacctacgagaaggacgtcgacctgggcgccgggacgcgcagcgtgtccaccgagaccgagaagcccgacatgaccgtgatcggccggcgcctgcagcggctccgcgaggagcacaaggagacgtggcactacgaccaggagaacccctaccggacctgggcctaccacgggagctacgaggccccgtccaccggcagcgcgtccagcatggtcaacggcgtggtgaagctgctgaccaagccctgggacgtcatccccatggtgacgcagctcgccatgaccgacaccacccccttcgggcagcagcgcgtgttcaaggagaaggtcgacacgcggaccccgcagcccaagcccggcacccgcatgatcatgaccacgaccgccaactggctgtgggccctgctcgggaagaagaagtccccccggctgtgcacccgcgaggagttcatcagcaaggtgcggtccaacgccgcgatcggcgccgtgttccaggaggagcaggggtggaccagcgcctccgaggccgtcaacgacagccgcttctgggagctggtggacaaggagcgggccctccaccaggagggcaagtgcgagagctgcgtgtacaacatgatgggcaagcgcgagaagaagctgggggagttcggccgcgcgaaggggtcccgggccatctggtacatgtggctgggcgcccgcttcctcgagttcgaggccctggggttcctgaacgaggaccactggttcagccgggagaactcctggagcggcgtcgagggcgaggggctccaccgcctgggctacatcctggaggacatcgacaagaaggacggggacctcatctacgccgacgacacggcgggctgggacacccggatcaccgaggacgacctgctgaacgaggagctcatcaccgagcagatggccccgcaccacaagacgctggccaaggccatcttcaagctgacctaccagaacaaggtggtgaaggtcctccgccccacccccaagggcgcggtgatggacatcatctcccggaaggaccagcgcgggagcggccaggtggggacctacggcctgaacaccttcacgaacatggaggtccagctgatccggcagatggaggccgagggggtgatcacccaggacgacatgcagaaccccaagggcctcaaggagcgcgtggagaagtggctgaaggagtgcggcgtcgaccggctgaagcgcatggccatctccggggacgactgcgtggtgaagccgctcgacgagcggttcagcacctccctgctgttcctcaacgacatgggcaaggtccgcaaggacatcccccagtgggagcccagcaaggggtggaagaactggcaggaggtgcccttctgctcccaccacttccacaagatcttcatgaaggacggccggagcctggtggtcccgtgccgcaaccaggacgagctgatcgggcgggcccgcatctcccagggcgccggctggagcctccgggagaccgcgtgcctggggaaggcctacgcccagatgtggtccctgatgtacttccaccgccgcgacctccggctggccagcatggccatctgctccgcggtgcccacggagtggttccccaccagccgcaccacctggagcatccacgcccaccaccagtggatgacgaccgaggacatgctgaaggtgtggaaccgggtctggatcgaggacaaccccaacatgaccgacaagaccccggtgcactcctgggaggacatcccctacctcggcaagcgcgaggacctgtggtgcgggagcctgatcggcctctccagccgggccacgtgggccaagaacatccacaccgccatcacccaggtgcgcaacctgatcgggaaggaggagtacgtcgactacatgcccgcgatgaagcggtactccgcccccttcgagagcgagggcgtgctgtga

SEQ ID NO: 10485 - RNA, 9867 nt, synthetic construct
  misc_feature 1..9867: note = derived and/or modified CDS sequence (opt1) from DENV-4__JF262783__SS-prME
  source 1..9867: mol_type = other RNA
agcaccgtgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgccatggacctgggggagatgtgcgaggacaccgtgatgtacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacgcgggccgagacctggatgagctccgagggggcctggaagcacgcccagcgcgtggagagctggatcctgcggaaccccggcttcgcgctgctcgccgggttcatggcctacatgatcggccagaccgggatccagcgcaccgtgttcttcgtgctgatgatgctggtcgccccctcctacggcatgcggtgcgtgggcgtggggaaccgcgacttcgtcgagggcgtgagcgggggcgcgtgggtggacctcgtcctggagcacggcgggtgcgtgacgaccatggcccagggcaagcccaccctggacttcgagctcatcaagaccacggccaaggaggtgaccctgctgcggacctactgcatcgaggcctccatcagcaacatcaccacggccacccgctgcccgacccagggggagccctacctcaaggaggagcaggaccagcagtacatctgccggcgcgacgtcgtggaccggggctgggggaacggctgcggcctgttcgggaagggcggggtggtgacctgcgcgaagttcctgtgctccggcaagatcacggggaacctcgtgcagatcgagaacctggagtacaccgtggtcgtgaccgtccacaacggcgacacccacgtggtgggcaaggacacgagcaaccacggggtcaccgccaccatcacgccccgctcccccagcgtggaggtgaagctgccggactacggcgagctcacgctggactgcgagccccggtccgggatcgacttcaacgagatgatcctgatgaagatgaagaagaagacctggctcgtccacaagcagtggttcctggacctgcccctcccctggaccgccggcgccgacaccagcgaggtgcagtggaactacaaggagcgcatggtgaccttcaaggtcccgcacgccaagcggcaggacgtgacggtgctggggtcccaggagggcgcgatgcacagcgccctgaccggcgccaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgcgggggccccctgcaaggtgcccatcgagatccgggacgtcaacaaggagaaggtggtgggccgcatcatcagctccacccccttcgccgagaacacgaacagcgtcaccaacatcgagctggagccgcccttcggggactcctacatcgtgatcggcgtgggcgacagcgccctcaccctgcactggttccggaaggggtccagcatcggcaagatgttcgagtccacctaccgcggggccaagcggatggcgatcctgggcgagacggcctgggacttcgggagcgtcggcggcctcttcacctccctggggaaggccgtgcaccaggtgttcggcagcgtctacaccaccatgttcgggggcgtgtcctggatggtgcgcatcctgatcgggctcctggtcctgtggatcggcacgaacagccggaacacctccatggccatgacctgcatcgcgatcggcgggatcaccctgttcctcggcttcacggtgcacgccgacatggggtgcgccgtgagctggtccggcaaggagctgaagtgcgggagcggcatcttcgtcatcgacaacgtgcacacctggaccgagcagtacaagttccagcccgagagccccgcccgcctggcctccgcgatcctcaacgcccacaaggacggcgtgtgcgggatccggagcaccacgcgcctggagaacgtcatgtggaagcagatcaccaacgagctgaactacgtgctctgggagggcgggcacgacctgaccgtggtcgccggcgacgtgaagggcgtgctgaccaaggggaagcgggccctcacgccgcccgtcaacgacctgaagtactcctggaagacctggggcaaggccaagatcttcacccccgaggcgcgcaacagcaccttcctgatcgacgggcccgacacgtccgagtgcccgaacgagcggcgcgcctggaacttcctcgaggtggaggactacggcttcgggatgttcgccaccaacatctggatgaagttccgggagggcagctccgaggtgtgcgaccaccgcctgatgagcgccgccatcaaggaccagaaggcggtccacgccgacatgggctactggatcgagtccagcaagaaccagacctggcagatcgagaaggcctccctgatcgaggtgaagacctgcctctggcccaagacgcacaccctgtggagcaacgaggtgctggagtcccagatgctcatccccaaggcctacgcggggccgttcagccagcacaactaccggcagggctacgccacccagaccatcgggccctggcacctgggcaagctggagatcgacttcggggagtgccccggcaccacggtcaccatccaggaggactgcaaccaccgcggcccctccctccggaccaccacggccagcgggaagctggtgacccagtggtgctgccgctcctgcaccatgccgcccctgcgcttcctcggcgaggacgggtgctggtacggcatggagatccggcccctgagcgagaaggaggagaacatggtcaagagccaggtctccgccgggcagggcaccagcgagacgttctccatgggcctgctctgcctgaccctgttcgtggaggagtgcctccgccggcgcgtcacccggaagcacatgatcctggtggtggtcaccacgctgtgcgccatcatcctcgggggcctgacctggatggacctgctccgcgcgctgatcatgctgggggacaccatgagcggccggatgggcgggcagatccacctcaccatcatggccgtgttcaagatgtcccccggctacgtgctgggggtcttcctgcgcaagctcacgagccgggagaccgccctgatcgtgatcggcatggccatgaccaccgtgctgtccatcccgcacgacctcatggagttcatcgacgggatcagcctgggcctgatcctcctgaagatggtcgcccacttcgacaacacccaggtgggcaccctggcgctctccctgaccttcatccgcagcaccatgcccctggtgatggcctggcggacgatcatggccgtcctcttcgtggtgaccctgatccccctgtgccgcacctcctgcctccagaagcagagccactgggtcgagatcaccgccctgatcctgggggcccaggcgctccccgtgtacctgatgacgctgatgaagggcgcctccaagcggagctggccgctcaacgaggggatcatggccgtgggcctggtctccctgctcgggagcgccctgctgaagaacgacgtgcccctcgcgggccccatggtggccggcgggctgctgctcgccgcctacgtcatgtccggcagctccgccgacctgagcctggagaaggcggccaacgtgcagtgggacgagatggccgacatcaccgggagctcccccatcatcgaggtgaagcaggacgaggacggcagcttctccatccgcgacgtcgaggagaccaacatgatcaccctcctggtgaagctggccctcatcacggtgagcgggctgtacccgctggccatccccgtcaccatggcgctctggtacatgtggcaggtcaagacccagcggtccggcgccctgtgggacgtgcccagccccgccgccgcccagaaggcgaccctgacggagggcgtctaccgcatcatgcagcggggcctcttcggcaagacccaggtgggggtgggcatccacatggagggggtcttccacaccatgtggcacgtgacccgcggctccgtgatctgccacgagaccggccggctggagccgagctgggccgacgtccgcaacgacatgatctcctacgggggcgggtggcggctgggcgacaagtgggacaaggaggaggacgtccaggtgctcgccatcgagcccggcaagaaccccaagcacgtccagacgaagcccgggctgttcaagaccctgaccggcgagatcggggccgtgaccctcgacttcaagccgggcacgagcgggtcccccatcatcaacaagaagggccgcgtgatcggcctgtacgggaacggcatcgtcaccaagagcggggactacgtgtccgccatcacccaggcggagcgcatcggcgagcccgactacgaggtggacgaggacatcttccggaagaagcgcctgaccgtcatggacctccacccgggggccggcaagacgaagcggatcctgcccagcatcgtgcgcgaggccctgaagcggcgcctgcggaccctcatcctggcccccacccgcgtggtcgcggccgagatggaggaggccctgcggggcctccccatccgctaccagaccccggccgtgaagtccgagcacacggggcgggagatcgtggacctgatgtgccacgccaccttcaccacccgcctgctcagctccacgcgggtccccaactacaacctgatcgtgatggacgaggcgcacttcaccgaccccagctccgtcgccgcccgcggctacatcagcacccgggtggagatgggggaggccgccgcgatcttcatgaccgccacgcccccgggcgccaccgaccccttcccccagagcaactcccccatcgaggacatcgagcgcgagatcccggagcggagctggaacaccgggttcgactggatcaccgactaccagggcaagacggtgtggttcgtcccctccatcaaggccggcaacgacatcgccaactgcctgcgcaagagcgggaagaaggtgatccagctctcccggaagaccttcgacaccgagtaccccaagaccaagctgacggactgggacttcgtggtcaccaccgacatcagcgagatgggcgcgaacttccgcgcccgccgggtgatcgacccccgccggtgcctgaagccggtgatcctcaccgacgggcccgagcgcgtcatcctggccggccccatccccgtgacgccggcctccgcggcccagcggcgcgggcggatcggccgcaaccccgcccaggaggacgaccagtacgtgttcagcggcgaccccctgaagaacgacgaggaccacgcccactggaccgaggccaagatgctcctggacaacatctacacccccgaggggatcatcccgaccctgttcggccccgagcgggagaagatccaggcgatcgacggggagttccgcctccggggcgagcagcgcaagacgttcgtcgagctgatgcggcgcggcgacctgcccgtgtggctctcctacaaggtggccagcgccgggatctcctacaaggaccgggagtggtgcttcaccggcgagcgcaacaaccagatcctggaggagaacatggaggtcgagatctggacccgggagggggagaagaagaagctgcgccccaagtggctcgacgcccgggtgtacgccgacccgatggcgctgaaggacttcaaggagttcgccagcggccgcaagtccatcaccctggacatcctcacggagatcgccagcctgcccacctacctgtccagccgggccaagctcgccctggacaacatcgtgatgctgcacaccaccgagcgcgggggccgcgcgtaccagcacgccctcaacgagctgcccgagtccctggagaccctcatgctggtcgccctgctcggcgccatgacggcggggatcttcctgttcttcatgcagggcaaggggatcggcaagctgagcatggggctcatggccatcgccgtggcctccggcctgctgtgggtggccgagatccagccgcagtggatcgcggccagcatcatcctcgagttcttcctgatggccctgctcatccccgagcccgagaagcagcggacgccccaggacaaccagctgatctacgtcatcctgaccatcctcaccatcatcggcctgatcgccgccaacgagatggggctgatcgagaagacgaagaccgacttcggcttctaccaggtgaagaccgagaccacgatcctcgacgtggacctgcgcccggcgagcgcctggaccctgtacgccgtcgccaccaccatcctcacgcccatgctgcggcacaccatcgagaacacctccgccaacctgagcctcgcggccatcgccaaccaggccgccgtgctgatggggctgggcaaggggtggcccctccaccgcatggacctgggcgtgcccctgctcgcgatgggctgctactcccaggtcaacccgaccacgctgaccgccagcctggtgatgctctccgtgcactacgccatcatcgggcccggcctgcaggccaaggcgacccgggaggcccagaagcgcaccgccgccgggatcatgaagaaccccacggtcgacggcatcaccgtgatcgacctggagcccatcagctacgacccgaagttcgagaagcagctcggccaggtgatgctgctggccctctgcgcggggcagctgctgctcatgcggaccacctgggccttctgcgaggtcctgacgctggccaccggccccatcctcaccctgtgggaggggaaccccggccgcttctggaacaccacgatcgccgtgtccaccgccaacatcttccgggggagctacctggcgggcgccggcctcgccttctccctgatcaagaacgcccagacgccccggcgggggaccggcacgaccggggagaccctgggcgagaagtggaagcgccagctcaacagcctggaccggaaggagttcgaggagtacaagcgctccgggatcctggaggtggaccggaccgaggccaagagcgcgctcaaggacggctccaagatcaagcacgccgtcagccgcggctccagcaagatccggtggatcgtggagcgcgggatggtgaagccgaagggcaaggtcgtggacctggggtgcggccgcggcgggtggtcctactacatggccacgctgaagaacgtgaccgaggtcaaggggtacaccaagggcgggcccgggcacgaggagcccatccccatggccacctacggctggaacctcgtgaagctgcacagcggggtggacgtcttctacaagccgaccgagcaggtcgacacgctgctctgcgacatcggcgagtccagcagcaaccccaccatcgaggagggccgcaccctgcgcgtgctgaagatggtcgagccctggctctccagcaagcccgagttctgcatcaaggtgctgaacccgtacatgcccaccgtgatcgaggagctggagaagctgcagcggaagcacgggggctccctcgtccgctgccccctgagccggaactccacgcacgagatgtactgggtgagcggggcgtccggcaacatcgtcagctccgtgaacaccaccagcaagatgctgctcaaccgcttcaccacgcggcaccgcaagcccacctacgagaaggacgtgaacctgggcgccgggacccggtccgtcagcaccgagacggagaagccggacatgaccatcatcggccgccggctgcagcgcctccgggaggagcacaaggagacctggcactacgaccaggagaacccctaccgcacctgggcctaccacgggtcctacgaggcccccagcacgggctccgccagctccatggtgaacggggtggtcaagctgctgaccaagccgtgggacgtgatccccatggtgacccagctcgcgatgaccgacacgacccccttcggccagcagcgggtcttcaaggagaaggtggacacccgcacgccccagccgaagcccggcacgcggatggtgatgaccaccaccgccaactggctgtgggccctgctcgggaagaagaagtccccgcgcctgtgcacgcgggaggagttcatctccaaggtccgcagcaacgccgccatcggcgcggtgttccaggaggagcaggggtggaccagcgcctccgaggccgtgaacgacagccggttctgggagctggtcgacaaggagcgcgccctccaccaggagggcaagtgcgagtcctgcgtgtacaacatgatggggaagcgggagaagaagctgggcgagttcggccgcgccaaggggagccgcgcgatctggtacatgtggctgggcgcccggttcctcgagttcgaggccctggggttcctgaacgaggaccactggttcggccgcgagaactcctggagcggggtggagggcgagggcctccaccggctggggtacatcctggaggacatcgacaagaaggacggcgacctcatctacgccgacgacaccgcggggtgggacacccgcatcacggaggacgacctgctgaacgaggagctcatcaccgagcagatggcgccccaccaccggatcctggccaaggccatcttcaagctgacctaccagaacaaggtcgtgaaggtgctccgccccacccccaagggcgccgtcatggacatcatctcccggaaggaccagcgcggcagcggccaggtgggcacgtacgggctgaacaccttcaccaacatggaggtgcagctgatccggcagatggaggcggagggcgtcatcacccaggacgacatgcagaaccccaaggggctcaaggagcgcgtggagaagtggctgaaggagtgcggcgtggaccggctgaagcgcatggccatctccggcgacgactgcgtcgtgaagcccctcgacgagcggttcagcacctccctgctgttcctcaacgacatggggaaggtgcgcaaggacatcccgcagtgggagcccagcaagggctggaagaactggcaggaggtccccttctgctcccaccacttccacaagatcttcatgaaggacgggcggagcctggtggtgccctgccgcaaccaggacgagctgatcggccgggcccgcatctcccagggggccggctggagcctccgggagacggcctgcctgggcaaggcgtacgcccagatgtggtccctgatgtacttccaccgccgcgacctccggctggccagcatggccatctgcagcgccgtcccgaccgagtggttccccacctcccgcaccacgtggagcatccacgcgcaccaccagtggatgaccaccgaggacatgctgaaggtgtggaaccgggtgtggatcgaggacaaccccaacatgaccgacaagacgcccgtccactcctgggaggacatcccgtacctcgggaagcgcgaggacctgtggtgcggcagcctgatcgggctctccagccgggccacctgggccaagaacatccacaccgccatcacccaggtgcgcaacctgatcggcaaggaggagtacgtggactacatgcccgtcatgaagcggtactccgcccccttcgagagcgagggggtgctgtga

SEQ ID NO: 10486 - RNA, 9867 nt, synthetic construct
  misc_feature 1..9867: note = derived and/or modified CDS sequence (opt1) from DENV-4__KU513441__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagcgcgtggtcggccgggtgatcagcgccacgcccctggcggagaacaccaactccgtgaccaacatcgagctcgagccgcccttcggggacagctacatcgtcatcggcgtgggcaactccgccctgaccctgcactggttccgcaaggggagctccatcggcaagatgttcgagagcacgtaccggggggccaagcgcatggccatcctcggcgagaccgcgtgggacttcgggtccgtgggcggcctgttcaccagcctggggaaggccgtccaccaggtgttcggctccgtgtacaccacgatgttcgggggcgtcagctggatgatccggatcctcatcgggttcctggtgctgtggatcggcaccaactcccgcaacaccagcatggccatgacctgcatcgccgtgggcgggatcacgctgttcctcggcttcaccgtccaggccgacatggggtgcgtggtgtcctggagcggccgggagctgaagtgcgggtccggcatcttcgtcgtggacaacgtgcacacctggaccgagcagtacaagttccagcccgagagccccgcgcgcctggccagcgccatcctcaacgcccacaaggacggcgtctgcgggatccggtccacgacccgcctggagaacgtgatgtggaagcagatcaccaacgagctgaactacgtgctctgggagggcgggcacgacctgaccgtcgtggccggcgacgtgaagggcgtcctgacgaaggggaagcgggcgctcaccccgcccgccagcgacctgaagtactcctggaagacctggggcaaggccaagatcttcacccccgaggcccgcaacagcacgttcctgatcgacgggcccgacacctccgagtgcccgaacgagcggcgcgcctggaacagcttcgaggtggaggactacggcttcgggatgttcaccaccaacatctggatgaagttccgggagggctccagcgaggtgtgcgaccaccgcctcatgtccgcggccatcaaggaccagaaggccgtccacgccgacatgggctactggatcgagagctccaagaaccagacgtggcagatcgagcgggcgagcctgatcgaggtgaagacctgcctgtggcccaagacccacaccctctggtccaacggggtgctggagagccagatgctgatccccaagtcctacgccggcccgttcagccagcacaactaccgccaggggtacgccacccagacggtcggcccctggcacctcgggaagctggagatcgacttcggcgagtgccccggcaccaccgtgaccatccaggagaactgcgaccaccgcgggccctccctgcggacgaccaccgccagcggcaagctcgtgacccagtggtgctgccgcagctgcacgatgccgcccctgcggttcctgggggaggacggctgctggtacgggatggagatccgccccctctccgagaaggaggagaacatggtcaagagccaggtgaccgccggccagggcacctccgagaccttcagcatggggctgctgtgcctcacgctgttcgtcgaggagtgcctgcggcgccgggtgacccgcaagcacatgatcctcgcggtggtcatcaccctgtgcgccatcatcctgggcgggctcacctggatggacctgctgcgggccctcatcatgctgggcgacacgatgtccggccgcatcgggggccagacccacctggccatcatcgccgtgttcaagatgagccccgggtacgtgctcggcgtcttcctgcggaagctgacctcccgcgagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccggtccaccatgagcctggtgatggcctggcgcacgatcatggccgtgctcttcgtcgtgaccctgatccccctgtgccggacctcctgcctccagaagcagagccactgggtggagatcaccgcgctgatcctgggcgcccaggccctccccgtctacctgatgacgctgatgaagggggcctcccgccggagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgcgacgtggaggagaccaacatgatcaccctcctggtcaagctggcgctcatcacggtgagcggcctgtaccccctggccatcccgatcaccatgaccctctggtacatgtggcaggtgaagacccagcggtccggcgccctgtgggacgtccccagccccgccgccacccagaaggcggccctgtccgagggggtgtaccgcatcatgcagcggggcctcttcgggaagacgcaggtgggcgtcgggatccacatggagggcgtgttccacaccatgtggcacgtgacccgcggcagcgtcatctgccacgagaccgggcgcctggagccctcctgggccgacgtgcggaacgacatgatcagctacggcgggggctggcgcctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccggaagggcaaggtcatcgggctgtacggcaacggggtggtgaccaagtccggcgactacgtcagcgcgatcacccaggccgagcgcatcggggagcccgactacgaggtggacgaggacatcttccggaagaagcgcctgaccatcatggacctccaccccggcgccggcaagacgaagcggatcctgccgtccatcgtgcgcgaggccctgaagcggcgcctgcggaccctcatcctggcgcccacccgcgtcgtggccgccgagatggaggaggccctgcgggggctccccatccgctaccagacccccgccgtgaagagcgagcacacgggccgggagatcgtcgacctgatgtgccacgcgaccttcaccacccgcctgctctccagcacgcgggtgccgaactacaacctgatcgtgatggacgaggcccacttcaccgaccccagctccgtcgccgcccgcgggtacatcagcacccgggtggagatgggcgaggccgcggccatcttcatgaccgccacgccccccggggccaccgacccgttcccccagtccaacagccccatcgaggacatcgagcgcgagatccccgagcgctcctggaacaccggcttcgactggatcaccgactaccagggcaagacggtctggttcgtgccgagcatcaaggccgggaacgacatcgcgaactgcctgcggaagtccggcaagaaggtgatccagctcagccgcaagaccttcgacaccgagtaccccaagaccaagctgacggactgggacttcgtcgtgaccaccgacatctccgagatgggggccaacttccgggccggccgcgtgatcgacccccggcgctgcctgaagcccgtcatcctcaccgacgggccggagcgggtgatcctggccggccccatccccgtgacgcccgcgagcgccgcccagcgccggggccgcatcgggcggaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgcgagaagacgcaggccatcgacggcgagttccggctccgcggggagcagcggaagaccttcgtggagctgatgcgccggggcgacctgcccgtgtggctcagctacaaggtcgcctccgccgggatcagctacaaggaccgcgagtggtgcttcaccggcgagcggaacaaccagatcctggaggagaacatggaggtggagatctggacccgcgagggggagaagaagaagctgcggcccaagtggctcgacgcccgcgtgtacgcggaccccatggccctgaaggacttcaaggagttcgcctccggccgcaagagcatcaccctggacatcctcacggagatcgcctccctgccgacctacctgagctcccgggccaagctcgcgctggacaacatcgtcatgctgcacaccaccgagcgcggcgggcgggcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcgcaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcggcccgcctccgcgtggaccctgtacgccgtggccacgaccatcctcaccccgatgctgcgccacaccatcgagaacacgagcgccaacctgtccctcgccgcgatcgccaaccaggccgccgtcctgatggggctgggcaagggctggcccctccaccggatggacctgggggtgcccctgctcgccatgggctgctacagccaggtgaaccccaccaccctgaccgcgtccctggtcatgctcctggtgcactacgccatcatcgggccgggcctgcaggccaaggccacgcgcgaggcgcagaagcggaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcgcacgacctgggccttctgcgaggtcctgaccctcgcgaccggcccgatcctgacgctgtgggaggggaaccccggccggttctggaacaccaccatcgccgtgtccaccgccaacatcttccgcggcagctacctcgccggggccggcctggcgttctccctgatcaagaacgcccagacgccccggcgcgggaccggcaccgccggggagaccctcggcgagaagtggaagcggcagctgaacagcctggaccgcaaggagttcgaggagtacaagcggtccggcatcctcgaggtggaccgcaccgaggccaagagcgccctgaaggacgggtccaagatcaagcacgcggtcagccggggctccagcaagatccgctggatcgtggagcgcgggatggtgaagcccaagggcaaggtcgtggacctggggtgcggccggggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccgcaccctgcgggtgctcaagatggtcgagccctggctgtccagcaagcccgagttctgcatcaaggtgctgaacccctacatgccgacggtgatcgaggagctggagaagctccagcgcaagcacgggggcaacctggtccggtgccccctgtcccgcaacagcacccacgagatgtactgggtgtccggcgccagcgggaacatcgtctccagcgtgaacaccacctccaagatgctcctgaaccggttcacgacccgccaccggaagcccacctacgagaaggacgtggacctgggcgcggggacccgcagcgtctccacggagatcgagaagcccgacatgaccatcatcggccggcgcctccagcggctgcaggaggagcacaaggagacctggcactacgaccaggagaacccgtaccgcacctgggcctaccacgggagctacgaggccccctccacgggcagcgcctccagcatggtgaacggcgtggtcaagctgctcaccaagccctgggacgtgatcccgatggtgacccagctggccatgaccgacacgacccccttcgggcagcagcgggtcttcaaggagaaggtggacacccgcaccccccagcccaagccgggcacgcggatggtgatgaccaccaccgcgaactggctgtgggccctcctggggaagaagaagaacccccgcctgtgcacgcgggaggagttcatctccaaggtccgcagcaacgccgccatcggcgccgtgttccaggaggagcaggggtggaccagcgcgtccgaggccgtgaacgacagccggttctgggagctcgtcgacaaggagcgcgccctgcaccaggagggcaagtgcgagtcctgcgtgtacaacatgatgggcaagcgcgagaagaagctgggggagttcggccgggccaaggggagccgcgccatctggtacatgtggctcggcgcgcggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgccgacgacaccgccggctgggacacccgcatcacggaggacgacctgcagaacgaggagctcatcaccgagcagatggcgccccaccacaagatcctggccaaggccatcttcaagctgacctaccagaacaaggtcgtgaaggtgctccggcccaccccgcgcggggccgtcatggacatcatctcccggaaggaccagcgcggcagcgggcaggtgggcacctacgggctgaacacgttcaccaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggcgatctccggcgacgactgcgtcgtgaagcccctcgacgagcgcttcgggaccagcctgctgttcctcaacgacatgggcaaggtgcggaaggacatcccccagtgggagccgtccaaggggtggaagaactggcaggaggtccccttctgcagccaccacttccacaagatcttcatgaaggacggccgctccctggtggtgccctgccggaaccaggacgagctgatcggccgcgcccgcatcagccagggggccggctggtccctccgggagacggcctgcctggggaaggcctacgcgcagatgtggagcctgatgtacttccaccgccgggacctccgcctggcctccatggccatctgcagcgccgtccccaccgagtggttcccgaccagccggaccacgtggtccatccacgcccaccaccagtggatgaccaccgaggacatgctgaaggtgtggaaccgcgtgtggatcgaggacaaccccaacatgatcgacaagacccccgtccacagctgggaggacatcccctacctcggcaagcgggaggacctgtggtgcgggtccctgatcggcctcagctcccgcgcgacgtgggccaagaacatccacaccgccatcacccaggtgcggaacctgatcggcaaggaggagtacgtggactacatgagcgtcatgaagcgctactccgccccgagcgagtccgagggggtgctgtga

SEQ ID NO: 10487 - RNA, 9867 nt, synthetic construct
  misc_feature 1..9867: note = derived and/or modified CDS sequence (opt1) from DENV-4__KC762694__SS-prME
  source 1..9867: mol_type = other RNA
agcaccatgaccctgctctgcctgatccccaccgtgatggccttccacctgtccacccgggacggcgagccgctcatgatcgtggccaagcacgagcgggggcgccccctgctgttcaagaccaccgagggcatcaacaagtgcacgctcatcgccatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatcagctccacccccttcgcggagaacacgaacagcgtgaccaacatcgagctggagccgcccttcggggactcctacatcgtgatcggcgtcggcgacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtgcaccaggtcttcggcagcgtgtacaccaccatgttcgggggcgtgtcctggatgatccgcatcctgatcgggttcctcgtcctgtggatcggcacgaacagccggaacacctccatggccatgacctgcatcgccgtgggcgggatcaccctgttcctgggcttcacggtgcaggccgacatggggtgcgtcgtgagctggaacggcaaggagctcaagtgcgggtccggcatcttcgtggtcgacaacgtgcacacctggaccgagcagtacaagttccagcccgagagccccgcgcgcctggccagcgccatcctgaacgcccacaaggacggcgtgtgcgggatccggtccaccagccgcctcgagaacgtcatgtggaagcagatcacgaacgagctgaactacgtgctgtgggagggcgggcacgacctcaccgtggtcgccggcgacgtgaagggcgtgctgaccaaggggaagcgggcgctgaccccgcccgtcaacgacctcaagtactcctggaagacgtggggcaaggccaagatcttcacccccgaggcccgcaacagcaccttcctgatcgacgggcccgacacctccgagtgcccgaacgagcggcgcgcctggaacttcttcgaggtggaggactacggcttcgggatgttcacgaccaacatctggatgaagttccgggagggcagctccgaggtgtgcgaccaccgcctgatgagcgccgcgatcaaggaccagaaggccgtccacgccgacatgggctactggatcgagtccagcaagaaccagacctggcagatcgagaaggcctccctcatcgaggtgaagacctgcctgtggcccaagacgcacaccctgtggagcaacggggtgctcgagtcccagatgctgatcccccggagctacgcgggcccgttctcccagcacaactaccgccaggggtacgccacccagaccgccggcccctggcacctggggaagctcgagatcgacttcggcgagtgccccggcaccacggtcaccatccaggaggactgcgaccaccgggggcccagcctgcgcaccaccacggcctccggcaagctggtgacccagtggtgctgccgcagctgcaccatgccgcccctccggttcctgggggaggacggctgctggtacgggatggagatccgccccctgagcgagaaggaggagaacatggtgaagtcccaggtcaccgccggccagggcacgagcgagaccttctccatggggctcctgtgcctgaccctcttcgtggaggagtgcctgcggcgccgggtcacccgcaagcacatgatcctggtggtggtcatcacgttctgcgcgatcatcctcggcgggctgacctggatggacctgctccgggccctgatcatgctgggcgacaccatgagcggccgcatcgggggccagatccacctcgccatcatggccgtgttcaagatgtcccccgggtacgtgctgggcgtcttcctgcggaagctcaccagccgcgagacggccctgatggtgatcgggatggcgatgaccaccgtgttctccatcccgcacgacctgatggagctcatcgacggcatcagcctgggcctgatcctcctgaagatcgtcacccacttcgacaacacccaggtggggaccctggccctctccctgaccttcatccggagcaccacgcccctggtgatggcctggcgcaccatcatggccgtcttcttcgtggtgaccctcatccccctgtgccggacctcctgcctgcagaagcagagccactgggtcgagatcacggccctcatcctgggcgcgcaggccctgcccgtgtacctcatgaccctgatgaagggggcctcccgccggagctggccgctgaacgagggcatcatggccgtggggctcgtctccctgctgggcagcgcgctcctgaagaacgacgtgcccctggccggccccatggtggccgggggcctcctgctggccgcctacgtcatgtccgggagctccgcggacctcagcctggagaaggccgccaacgtgcagtgggacgagatggccgacatcaccggcagctcccccatcatcgaggtgaagcaggacgaggacgggagcttctccatccgcgacgtcgaggagaccaacatgatcacgctgctcgtgaagctggccctgatcaccgtgagcggcctctacccgctggcgatccccgtcaccatggccctgtggtacgtgtggcaggtcaagacccagcggtccggcgccctctgggacgtccccagccccgccgccacgcagaaggcgaccctgtccgagggggtgtaccgcatcatgcagcggggcctgttcgggaagacccaggtgggcgtcgggatccacatggagggcgtgttccacaccatgtggcacgtgacccgcggcagcgtcatctgccacgagacggggcggctcgagccgtcctgggccgacgtgcgcaacgacatgatcagctacggcgggggctggcgcctgggcgacaagtgggacaaggaggaggacgtgcaggtcctggccatcgagcccgggaagaaccccaagcacgtgcagaccaagcccggcctcttcaagaccctgaccggggagatcggcgccgtgacgctggacttcaagccggggacctccggcagccccatcatcaacaagaagggcaaggtcatcgggctctacggcaacggggtggtgaccaagtccggcgactacgtcagcgccatcacccaggcggagcggatcggggagcccgactacgaggtggacgaggacatcttccgcaagaagcggctgacgatcatggacctgcacccgggcgccggcaagaccaagcgcatcctcccctccatcgtgcgggaggccctgaagcgccggctgcgcaccctcatcctggcccccacccgggtcgtggcggccgagatggaggaggccctgcgcgggctgcccatccggtaccagacgccggccgtgaagtccgagcacaccggccgcgagatcgtcgacctcatgtgccacgccaccttcaccacgcggctgctgtccagcacccgcgtgcccaactacaacctcatcgtcatggacgaggcgcacttcaccgacccctgctccgtggccgcccgggggtacatcagcacccgcgtggagatgggcgaggccgccgcgatcttcatgacggccacgcccccggggagcatcgaccccttcccccagtccaacagccccatcgaggacatcgagcgggagatcccggagcgctcctggaacaccggcttcgactggatcaccgactaccagggcaagacggtctggttcgtgcccagcatcaaggccgggaacgacatcgccaactgcctgcggaagtccggcaagcgcgtgatccagctgagccgcaagaccttcgacaccgagtaccccaagaccaagctcacggactgggacttcgtcgtgaccaccgacatctccgagatgggggccaacttccgggcgggccgcgtgatcgacccccggcgctgcctgaagccggtcatcctgaccgacgggcccgagcgggtgatcctcgccggccccatccccgtgacgccggccagcgccgcgcagcgccggggccgcatcgggcggaaccccgcccaggaggacgaccagtacgtcttctccggcgaccccctgaagaacgacgaggaccacgcccactggaccgaggccaagatgctgctcgacaacatctacacccccgaggggatcatcccgaccctgttcggccccgagcgcgagaagacgcaggccatcgacggcgagttccggctgcgcggggagcagcggaagaccttcgtggagctcatgcgccggggcgacctgcccgtgtggctgagctacaaggtcgcgtccgccgggatcagctacaaggaccgcgagtggtgcttcaccggcgagcggaacaaccagatcctcgaggagaacatggaggtggagatctggacccgcgagggggagaagaagaagctgcggcccaagtggctggacgcccgcgtgtacgccgacccgatggccctcaaggacttcaaggagttcgcgtccggccgcaagagcatcacgctggacatcctgaccgagatcgccaccctccccacctacctgtccagcaaggccaagctggccctcgacaacatcgtcatgctgcacaccacggagaagggcgggcgcgcctaccagcacgcgctgaacgagctccccgagtccctggagaccctgatgctcgtggccctgctgggcgccatgaccgccgggatcttcctcttcttcatgcagggcaaggggatcggcaagctgagcatgggcctgatcgcgatcgccgtggcctccgggctcctgtgggtcgccgagatccagccgcagtggatcgccgcgagcatcatcctggagttcttcctcatggtgctgctgatccccgagcccgagaagcagcgcacgccccaggacaaccagctcatctacgtgatcctgacgatcctgaccatcatcggcctcatcgccgccaacgagatggggctgatcgagaagaccaagaccgacttcggcttctaccaggtcaagacggagaccaccatcctggacgtggacctccggccggccagcgcctggaccctgtacgcggtggccacgaccatcctgacccccatgctccgccacaccatcgagaacacgtccgccaacctgagcctggccgccatcgcgaaccaggccgccgtcctcatggggctgggcaagggctggcccctgcaccggatggacctcggggtgcccctgctggccatgggctgctactcccaggtgaacccgaccaccctcaccgccagcctggtcatgctgctcgtgcactacgcgatcatcgggcccggcctgcaggccaaggccacgcgcgaggcccagaagcggaccgcggccggcatcatgaagaaccccaccgtggacgggatcaccgtcatcgacctggagcccatctcctacgacccgaagttcgagaagcagctcggccaggtgatgctgctggtgctctgcgtcgggcagctgctgctcatgcgcacgacctgggccctgtgcgaggtgctgaccctcgccaccggccccgtgatgacgctgtgggaggggaaccccggccggttctggaacaccaccatcgccgtcagcaccgcgaacatcttccgcggctcctacctggccggggccggcctcgccttcagcctgatcaagaacgcccagacgccccggcgcgggaccggcaccaccggggagacgctgggcgagaagtggaagcggcagctcaactccctggaccgcaaggagttcgaggagtacaagcggagcggcatcctggaggtggaccgcaccgaggcgaagtccgccctccgggacgggagcaagatcaagtacgccgtgtcccgcggcagctccaagatccggtggatcgtcgagcgcgggatgatcaagccgaagggcaaggtggtggacctggggtgcggccggggcgggtggagctactacatggccaccctgaagaacgtcaccgaggtgaagggctacaccaagggcggccccgggcacgaggagcccatccccatggccacgtacggctggaacctcgtgaagctgcactccggcgtcgacgtgttctacaagccgaccgagcaggtcgacaccctgctctgcgacatcggggagagctccagcaaccccaccatcgaggagggccgcacgctgcgcgtcctgaagatggtggagccctggctcagctccaagcccgagttctgcatcaaggtcctgaacccgtacatgcccaccgtgatcgaggagctggagaagctccagcggcgccacgggggcagcctggtgcggtgccccctgtcccgcaacagcacccacgagatgtactgggtctccggcgcgagcgggaacatcgtgtccagcgtgaacaccatctccaagatgctgctcaaccggttcacgacccgccaccggaagcccacctacgagaaggacgtcgacctgggcgccgggacccgcagcgtgtccacggagaccgagaagccggacatgaccatcatcggccggcgcctgcagcggctccgcgaggagcacaaggagacctggcactacgaccaggagaacccctaccggacgtgggcctaccacgggagctacgaggccccctccaccggcagcgcgtccagcatggtgaacggcgtcgtgaagctgctgaccaagccgtgggacgtgatccccatggtcacccagctcgccatgacggacaccacccccttcgggcagcagcgcgtgttcaaggagaaggtggacacccggacgccccagccgaagcccggcacccgcatgatcatgaccaccacggccaactggctgtgggccctgctcgggaagaagaagtccccgcggctgtgcacccgcgaggagttcatcagcaaggtccggagcaacgccgcgatcggcgccgtgttccaggaggagcaggggtggaccagcgccagcgaggccgtgaacgactcccgcttctgggagctggtcgacaaggagcgggccctccaccaggagggcaagtgcgagagctgcgtgtacaacatgatgggcaagcgcgagaagaagctgggggagttcggccgcgcgaaggggtcccgggccatctggtacatgtggctgggcgcccgcttcctcgagttcgaggccctggggttcctgaacgaggaccactggttcagccgggagaactcctggagcggcgtggagggcgaggggctccaccgcctgggctacatcctggaggacatcgacaagaaggacggggacctcatctacgccgacgacaccgcgggctgggacacgcggatcaccgaggacgacctgctgaacgaggagctcatcaccgagcagatggcgccccaccacaagaccctggccaaggccatcttcaagctgacgtaccagaacaaggtcgtgaaggtgctccgccccacccccaagggcgcggtcatggacatcatctcccggaaggaccagcgcgggagcggccaggtggggacctacggcctgaacaccttcaccaacatggaggtgcagctgatccggcagatggaggccgagggggtcatcacgcaggacgacatgcagaaccccaagggcctcaaggagcgcgtggagaagtggctgaaggagtgcggcgtggaccggctgaagcgcatggccatctccggggacgactgcgtcgtgaagcccctcgacgagcggttcagcacctccctgctgttcctcaacgacatgggcaaggtgcgcaaggacatcccgcagtgggagcccagcaaggggtggaagaactggcaggaggtccccttctgctcccaccacttccacaagatcttcatgaaggacggccggagcctggtggtgccctgccgcaaccaggacgagctgatcgggcgggcccgcatctcccagggcgccggctggagcctccgggagaccgcgtgcctggggaaggcctacgcccagatgtggtccctgatgtacttccaccgccgcgacctccggctggccagcatggccatctgcagcgcggtcccgaccgagtggttccccacgtcccgcaccacctggagcatccacgcccaccaccagtggatgaccacggaggacatgctgaaggtgtggaaccgggtgtggatcgaggacaaccccaacatgaccgacaagacccccgtccactcctgggaggacatcccgtacctcggcaagcgcgaggacctgtggtgcgggagcctgatcggcctctccagccgggccacctgggccaagaacatccacacggccatcacccaggtgcgcaacctgatcgggaaggaggagtacgtggactacatgcccgcgatgaagcggtactccgcccccttcgagagcgagggcgtcctgtga

SEQ ID NO: 10488 - RNA, 9867 nt, synthetic construct
  misc_feature 1..9867: note = derived and/or modified CDS sequence (opt1) from DENV-4__KC762695__SS-prME
  source 1..9867: mol_type = other RNA
agcaccatgaccctgctctgcctgatccccaccgccatggccttccacctgagcacccgggacggcgagccgctcatgatcgtggcgaagcacgagcgggggcgccccctgctgttcaagaccaccgagggcatcaacaagtgcacgctcatcgccatggacctgggggagatgtgcgaggacaccgtgacctacaagtgccccctgctcgtgaacaccgagcccgaggacatcgacagctggtgcaacctgacgtccacctgggtgatgtacgggacctgcacccagagcggggagcggcgccgggagaagcgctccgtggccctgacgccgcacagcggcatgggcctcgagacccgggccgagacctggatgtccagcgagggggcctggaagcacgcgcagcgcgtggagtcctggatcctgcggaaccccggcttcgccctgctcgccgggttcatggcctacatgatcggccagaccgggatccagcgcacggtgttcttcgtcctgatgatgctggtggcgcccagctacggcatgcggtgcgtgggcgtcgggaaccgcgacttcgtggagggcgtgtccgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgagcatctccaacatcacgaccgccacccgctgcccgacccagggggagccctacctcaaggaggagcaggaccagcagtacatctgccggcgcgacgtggtggaccggggctgggggaacggctgcggcctgttcgggaagggcggggtcgtgacgtgcgccaagttcctgtgcagcggcaagatcaccgggaacctcgtgcagatcgagaacctggagtacaccgtcgtggtgaccgtccacaacggcgacacgcacgccgtgggcaacgacacctccaaccacggggtcaccgccaccatcacgccccgcagcccctccgtggaggtgaagctgccggactacggcgagctcaccctggactgcgagccccggagcgggatcgacttcaacgagatgatcctgatgaagatgaagaagaagacctggctcgtccacaagcagtggttcctggacctgcccctcccctggaccgcgggcgccgacacctccgaggtgcactggaactacaaggagcgcatggtgacgttcaaggtcccgcacgccaagcggcaggacgtgaccgtgctggggagccaggagggcgccatgcacagcgccctggcgggcgccaccgaggtcgactccgggaacggcaaccacatgttcgccgggcacctcaagtgcaaggtgcgcatggagaagctgcgcatcaagggcatgagctacaccatgtgctccggcaagttcagcatcgacaaggagatggccgagacgcagcacgggaccaccgtggtcaaggtgaagtacgagggcgccggggcgccctgcaaggtgcccatcgagatccgggacgtcaacaaggagaaggtggtgggccgcatcatctccagcacccccttcgccgagaacacgaactccgtcaccaacatcgagctggagccgcccttcggggacagctacatcgtgatcggcgtgggcgactccgccctcaccctgcactggttccggaaggggagctccatcggcaagatgttcgagagcacctaccgcggggccaagcggatggcgatcctgggcgagacggcctgggacttcgggtccgtcggcggcctcttcaccagcctggggaaggccatccaccaggtgttcggctccgtgtacaccaccatgttcgggggcgtcagctggatgatccgcatcctgatcgggctcctggtgctgtggatcggcacgaactcccggaacaccagcatggccatgacctgcatcgccgtgggcgggatcaccctgttcctcggcttcacggtccaggcggacatggggtgcgtggtgtcctggaacggcaaggagctgaagtgcgggagcggcatcttcgtcgtggacaacgtgcacacctggaccgagcagtacaagttccagcccgagagccccgcccgcctggcctccgccatcctcaacgcccacaaggacggcgtctgcgggatccggagcaccacgcgcctggagaacgtgatgtggaagcagatcaccaacgagctgaactacgtgctctgggagggcgggcacgacctgaccgtcgtggcgggcgacgtgaagggcgtcctgaccaaggggaagcgggccctcacgccgcccgtgaacgacctgaagtactcctggaagacctggggcaaggccaagatcttcacccccgaggcccgcaacagcaccttcctgatcgacgggcccgacacgtccgagtgcccgaacgagcggcgcgcctggaacttcctcgaggtggaggactacggcttcgggatgttcagcaccaacatctggatgaagttccgggagggctccagcgaggtctgcgaccaccgcctgatgtccgcggccatcaaggaccagaaggccgtgcacgccgacatgggctactggatcgagagctccaagaaccagacctggcagatcgagaaggcgagcctgatcgaggtgaagacctgcctctggcccaagacgcacaccctgtggtccaacggggtcctggagagccagatgctcatcccccggtcctacgccggcccgttcagccagcacaactaccgccaggggtacgccacccagatcgccggcccctggcacctggggaagctggagatcgacttcggcgagtgccccggcaccaccgtgacgatccaggaggactgcgaccaccgggggccctccctccgcaccaccaccgccagcggcaagctggtgacgcagtggtgctgccgcagctgcaccatgccgcccctgcggttcctcggggaggacggctgctggtacgggatggagatccgccccctgtccgagaaggaggagaacatggtcaagagccaggtgaccgcgggccagggcacctccgagacgttcagcatggggctgctctgcctgaccctgttcgtggaggagtgcctccggcgccgggtcacccgcaagcacatgatcctggtggtcaccatcacgttctgcgccatcatcctgggcgggctcacctggatggacctgctgcgggccctcatcatgctgggcgacaccatgtccggccgcatcgggggccagatccacctggccatcatggccgtgttcaagatgagccccgggtacgtgctcggcgtcttcctgcggaagctgacctcccgcgagacggcgctcatggtgatcgggatggccatgaccaccgtgttcagcatcccgcacgacctgatggagctgatcgacggcatctccctcggcctgatcctgctcaagatcgtcacccacttcgacgacacccaggtggggaccctggccctgagcctcaccttcatccggtccaccacgcccctggtgatggcctggcgcaccatcatggccgtcttcttcgtggtgaccctgatccccctctgccggaccagctgcctgcagaagcagtcccactgggtcgagatcacggcgctgatcctcggcgcccaggccctgcccgtgtacctgatgaccctcatgaagggggccagccgccggtcctggccgctgaacgagggcatcatggcggtggggctggtcagcctcctgggctccgccctgctcaagaacgacgtgcccctggccggccccatggtggccgggggcctgctcctggccgcgtacgtcatgagcgggtccagcgccgacctgagcctcgagaaggccgccaacgtgcagtgggacgagatggccgacatcaccggctccagccccatcatcgaggtgaagcaggacgaggacgggtccttcagcatccgcgacgtcgaggagaccaacatgatcacgctgctggtgaagctcgcgctgatcaccgtgtccggcctgtacccgctcgccatccccgtcaccatggccctgtggtacatctggcaggtcaagacccagcggagcggcgccctgtgggacgtgccctcccccgtcgccacgcagaaggcgaccctcagcgagggggtgtaccgcatcatgcagcggggcctgttcgggaagacccaggtgggcgtcgggatccacatggagggcgtgttccacaccatgtggcacgtgacccgcggctccgtcatctgccacgagacggggcggctggagccgagctgggccgacgtgcgcaacgacatgatctcctacggcgggggctggcgcctcggcgacaagtgggacaaggaggaggacgtgcaggtcctggccatcgagcccgggaagaaccccaagcacgtgcagaccaagcccggcctgttcaagaccctcaccggggagatcggcgccgtgacgctggacttcaagccggggaccagcggctcccccatcatcaacaagaagggcaaggtcatcgggctgtacggcaacggggtggtgaccaagagcggcgactacgtctccgccatcacccaggcggagcggatcggggagcccgactacgaggtggacgaggacatcttccgcaagaagcggctcacgatcatggacctgcacccgggcgccggcaagaccaagcgcatcctgcccagcatcgtgcgggaggccctcaagcgccggctgcgcaccctgatcctggcccccacccgggtcgtggcggccgagatggaggaggccctccgcgggctgcccatccggtaccagacgccggccgtgaagtccgagcacaccggccgcgagatcgtcgacctgatgtgccacgccaccttcaccacgcggctcctgagctccacccgcgtgcccaactacaacctgatcgtgatggacgaggcgcacttcaccgacccctgcagcgtcgccgcccgggggtacatcagcacccgcgtggagatgggcgaggccgccgcgatcttcatgacggccacgcccccggggtccaccgaccccttcccccagagcaactcccccatcgaggacatcgagcgggagatcccggagcgcagctggaacaccggcttcgactggatcacggactaccagggcaagaccgtctggttcgtgccctccatcaaggccgggaacgacatcgccaactgcctccgcaagagcggcaagcgcgtgatccagctgtcccgcaagaccttcgacaccgagtaccccaagacgaagctgaccgactgggacttcgtcgtgaccaccgacatcagcgagatgggggccaacttccgggcgggccgcgtgatcgacccccggcgctgcctcaagccggtcatcctgacggacgggcccgagcgggtgatcctggccggccccatccccgtgaccccggcctccgccgcgcagcgccggggccgcatcgggcggaaccccgcccaggaggacgaccagtacgtcttcagcggcgaccccctcaagaacgacgaggaccacgcccactggaccgaggccaagatgctgctggacaacatctacacccccgaggggatcatcccgaccctcttcggccccgagcgcgagaagacccaggccatcgacggcgagttccggctgcgcggggagcagcggaagaccttcgtggagctgatgcgccggggcgacctccccgtgtggctgtcctacaaggtcgcgagcgccgggatctcctacaaggaccgcgagtggtgcttcaccggcgagcggaacaaccagatcctggaggagaacatggaggtggagatctggacgcgcgagggggagaagaagaagctccggcccaagtggctggacgcccgcgtgtacgccgacccgatggccctgaaggacttcaaggagttcgcgagcggccggaagtccatcaccctcgacatcctgaccgagatcgccaccctgcccacctacctcagctccaaggccaagctggccctggacaacatcgtcatgctccacacgaccgagaagggcgggcgcgcctaccagcacgcgctgaacgagctgcccgagagcctcgagaccctgatgctggtggccctcctgggcgccatgaccgccgggatcttcctgttcttcatgcagggcaaggggatcggcaagctctccatcggcctgatcgcgatcgccgtggccagcgggctgctctgggtcgccgagatccagccgcagtggatcgccgcgagcatcatcctggagttcttcctgatggtgctcctgatccccgagcccgagaagcagcgcacgccccaggacaaccagctgatctacgtgatcctcaccatcctgaccatcatcggcctgatcgccgccaacgagatggggctcatcgagaagaccaagacggacttcggcttctaccaggtcaagaccgagaccaccatcctggacgtggacctgcggccggcctccgcctggacgctctacgcggtggccaccaccatcctgacccccatgctgcgccacacgatcgagaacaccagcgccaacctctccctggccgccatcgcgaaccaggccgccgtcctgatggggctcggcaagggctggcccctgcaccggatggacctgggggtgcccctcctggccatgggctgctacagccaggtgaacccgaccaccctgacggcctccctcgtcatgctgctggtgcactacgcgatcatcgggcccggcctccaggccaaggccacccgcgaggcccagaagcggaccgcggccggcatcatgaagaaccccaccgtggacgggatcacggtcatcgacctggagcccatcagctacgacccgaagttcgagaagcagctgggccaggtgatgctcctggtgctgtgcgtcgggcagctcctgctgatgcgcaccacctgggccctctgcgaggtgctgaccctggccacgggccccatcatgaccctctgggaggggaaccccggccggttctggaacaccaccatcgccgtgtccacggcgaacatcttccgcggcagctacctggccggggccggcctggccttctccctcatcaagaacgcccagacgccccggcgcgggaccggcaccacgggggagaccctgggcgagaagtggaagcggcagctgaacagcctcgaccgcaaggagttcgaggagtacaagcggtccggcatcctggaggtcgaccgcaccgaggccaagagcgccctgcgggacgggtccaagatcaagcacgccgtgagccgcggctccagcaagatccggtggatcgtggagcgcgggatgatcaagccgaagggcaaggtcgtggacctcgggtgcggccggggcgggtggtcctactacatggccaccctgaagaacgtgaccgaggtcaagggctacacgaagggcggccccgggcacgaggagcccatccccatggccacctacggctggaacctggtgaagctccacagcggcgtggacgtcttctacaagccgaccgagcaggtcgacaccctgctgtgcgacatcggggagtccagcagcaaccccacgatcgaggagggccgcaccctccgcgtgctgaagatggtcgagccctggctgtccagcaagcccgagttctgcatcaaggtgctcaacccgtacatgcccaccgtgatcgaggagctggagaagctgcagcggcgccacgggggctccctggtccggtgccccctcagccgcaactccacccacgagatgtactgggtgagcggcgcgtccgggaacatcgtcagctccgtgaacacgatcagcaagatgctgctgaaccggttcaccacccgccaccggaagcccacctacgagaaggacgtggacctcggcgccgggacgcgctccgtcagcaccgagaccgagaagccggacatgaccatcatcggccggcgcctgcagcggctgcgcgaggagcacaaggagacgtggcactacgaccaggagaacccctaccggacctgggcctaccacgggtcctacgaggcccccagcaccggctccgcgagctccatggtgaacggcgtggtcaagctcctgaccaagccgtgggacgtgatccccatggtgacgcagctggccatgaccgacaccacccccttcgggcagcagcgcgtcttcaaggagaaggtggacacgcggacgccccagccgaagcccggcacccgcatgatcatgaccacgaccgccaactggctctgggccctgctggggaagaagaagtccccgcggctctgcacccgcgaggagttcatctccaaggtgcggagcaacgccgcgatcggcgccgtcttccaggaggagcaggggtggaccagcgcctccgaggccgtgaacgacagccgcttctgggagctggtggacaaggagcgggccctgcaccaggagggcaagtgcgagtcctgcgtctacaacatgatgggcaagcgcgagaagaagctcggggagttcggccgcgcgaaggggagccgggccatctggtacatgtggctgggcgcccgcttcctggagttcgaggccctcgggttcctgaacgaggaccactggttctcccgggagaacagctggtccggcgtggagggcgaggggctgcaccgcctcggctacatcctggaggacatcgacaagaaggacggggacctgatctacgccgacgacacggcgggctgggacacccggatcaccgaggacgacctcctgaacgaggagctgatcaccgagcagatggcgccccaccacaagacgctcgccaaggccatcttcaagctgacctaccagaacaaggtggtcaaggtgctgcgccccacccccaagggcgcggtgatggacatcatcagccggaaggaccagcgcgggtccggccaggtcgggacctacggcctcaacaccttcacgaacatggaggtgcagctgatccggcagatggaggccgagggggtgatcacccaggacgacatgcagaaccccaagggcctggaggagcgcgtcgagaagtggctcaaggagtgcggcgtggaccggctgaagcgcatggccatcagcggggacgactgcgtggtcaagcccctggacgagcggttctccaccagcctcctgttcctgaacgacatgggcaaggtgcgcaaggacatcccgcagtgggagccctccaaggggtggaagaactggcaggaggtgcccttctgcagccaccacttccacaagatcttcatgaaggacggccggtccctcgtcgtgccctgccgcaaccaggacgagctgatcgggcgggcccgcatcagccagggcgccggctggtccctgcgggagaccgcgtgcctcgggaaggcctacgcccagatgtggagcctgatgtacttccaccgccgcgacctgcggctcgccagcatggccatctgctccgcggtgccgacggagtggttccccatcagccgcaccacctggtccatccacgcccaccaccagtggatgaccacggaggacatgctgaaggtctggaaccgggtgtggatcgaggacaaccccaacatgaccgacaagacccccatccacagctgggaggacatcccgtacctgggcaagcgcgaggacctctggtgcgggtccctgatcggcctgagctcccgggccacctgggccaagaacatccacacggccatcagccaggtgcgcaacctcatcgggaaggaggagtacgtcgactacatgcccgtgatgaagcggtactccgcgcccagcgagtccgagggcgtgctgtga

SEQ ID NO: 10489 - RNA, 9867 nt, synthetic construct
  misc_feature 1..9867: note = derived and/or modified CDS sequence (opt1) from DENV-4__KC762696__SS-prME
  source 1..9867: mol_type = other RNA
agcaccatgaccctgctctgcctgatccccaccgtgatggccttccacctgagcacccgggacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatcagctccacccccttcgcggagaacacgaacagcgtgaccaacatcgagctggagccgcccttcggggactcctacatcgtgatcggcgtcggcgacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtgcaccaggtcttcggcagcgtgtacaccaccatgttcgggggcgtgtcctggatgatccgcatcctgatcgggttcctcgtcctgtggatcggcacgaacagccggaacacctccatggccatgacctgcatcgccgtgggcgggatcaccctgttcctgggcttcacggtgcaggccgacatggggtgcgtcgtgagctggaacggcaaggagctcaagtgcgggtccggcatcttcgtggtcgacaacgtgcacacctggaccgagcagtacaagttccagcccgagagccccgcgcgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgccggcgacgtgaagggcgtgctgaccaaggggaagcgggcgctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctcatcgaggtgaagacgtgcctgtggcccaagacccacaccctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcacgaccgtcaccatccaggaggactgcgaccaccgggggccctccctgcgcaccacgaccgccagcggcaagctggtgacccagtggtgctgccgctcctgcaccatgccgcccctccggttcctgggggaggacggctgctggtacgggatggagatccgccccctgagcgagaaggaggagaacatggtcaagagccaggtcacggccggccagggcacctccgagaccttcagcatggggctcctgtgcctgaccctcttcgtggaggagtgcctgcggcgccgggtcacgcgcaagcacatgatcctggtggtggtcatcaccttctgcgcgatcatcctcggcgggctgacctggatggacctgctccgggccctgatcatgctgggcgacaccatgtccggccgcatcgggggccagatccacctcgccatcatggccgtgttcaagatgagccccgggtacgtgctgggcgtcttcctgcggaagctcacgtcccgcgagaccgccctgatggtgatcgggatggcgatgaccaccgtgttcagcatcccgcacgacctgatggagctcatcgacggcatctccctgggcctgatcatcctcaagatcgtcacgcacttcgacaacacccaggtggggaccctggccctgagcctcaccttcatccggtccacgacgcccctggtgatggcctggcgcaccatcatggccgtcttcttcgtggtgaccctgatccccctctgccggacgagctgcctgcagaagcagtcccactgggtcgagatcaccgccctgatcctcggcgcgcaggccctgcccgtgtacctgatgaccctcatgaagggggccagccgccggtcctggccgctgaacgagggcatcatggccgtggggctggtcagcctcctgggctccgcgctgctcaagaacgacgtgcccctggccggccccatggtggccgggggcctgctcctggccgcctacgtcatgagcgggtccagcgcggacctgtccctcgagaaggccgccaacgtgcagtgggacgagatggccgacatcaccggcagcagccccatcatcgaggtgaagcaggacgaggacgggtccttcagcatccgcgacgtcgaggagacgaacatgatcaccctgctggtgaagctcgccctgatcaccgtgtccggcctgtacccgctcgcgatccccgtcaccatggccctgtggtacgtgtggcaggtcaagacgcagcggagcggcgccctgtgggacgtcccctcccccgccgccacccagaaggcgaccctcagcgagggggtgtaccgcatcatgcagcggggcctgttcgggaagacccaggtgggcgtcgggatccacatggagggcgtgttccacaccatgtggcacgtgacgcgcggctccgtcatctgccacgagaccgggcggctggagccgagctgggccgacgtgcgcaacgacatgatctcctacggcgggggctggcgcctcggcgacaagtgggacaaggaggaggacgtgcaggtcctggccatcgagcccgggaagaaccccaagcacgtgcagaccaagcccggcctgttcaagaccctcacgggggagatcggcgccgtgaccctggacttcaagccggggaccagcggctcccccatcatcaacaagaagggcaaggtcatcgggctgtacggcaacggggtggtgaccaagagcggcgactacgtctccgccatcacgcaggcggagcggatcggggagcccgactacgaggtggacgaggacatcttccgcaagaagcggctcaccatcatggacctgcacccgggcgccggcaagaccaagcgcatcctgcccagcatcgtgcgggaggccctcaagcgccggctgcgcaccctgatcctcgcccccacgcgggtcgtggcggccgagatggaggaggccctgcgcgggctgcccatccggtaccagaccccggccgtgaagtccgagcacaccggccgcgagatcgtcgacctgatgtgccacgccaccttcacgacccggctcctgagctccacccgcgtgcccaactacaacctgatcgtcatggacgaggcgcacttcaccgacccctgcagcgtggccgcccgggggtacatctccacgcgcgtggagatgggcgaggccgccgcgatcttcatgaccgccacgcccccggggagcatcgaccccttcccccagagcaactcccccatcgaggacatcgagcgggagatcccggagcgcagctggaacaccggcttcgactggatcacggactaccagggcaagaccgtctggttcgtgccctccatcaaggccgggaacgacatcgccaactgcctccgcaagagcggcaagcgcgtgatccagctgtcccgcaagaccttcgacaccgagtaccccaagacgaagctgaccgactgggacttcgtcgtgaccaccgacatcagcgagatgggggccaacttccgggcgggccgcgtgatcgacccccggcgctgcctcaagccggtcatcctgacggacgggcccgagcgggtgatcctggccggccccatccccgtgaccccggcctccgccgcgcagcgccggggccgcatcgggcggaaccccgcccaggaggacgaccagtacgtcttcagcggcgaccccctcaagaacgacgaggaccacgcccactggaccgaggccaagatgctgctggacaacatctacacccccgaggggatcatcccgaccctcttcggccccgagcgcgagaagacccaggccatcgacggcgagttccggctgcgcggggagcagcggaagaccttcgtggagctgatgcgccggggcgacctccccgtgtggctgtcctacaaggtcgcgagcgccgggatctcctacaaggaccgcgagtggtgcttcaccggcgagcggaacaaccagatcctggaggagaacatggaggtggagatctggacgcgcgagggggagaagaagaagctccggcccaagtggctggacgcccgcgtgtacgccgacccgatggccctgaaggacttcaaggagttcgcgagcggccggaagtccatcaccctcgacatcctgaccgagatcgccaccctgcccacctacctcagctccaaggccaagctggccctggacaacatcgtcatgctccacacgaccgagaagggcgggcgcgcctaccagcacgcgctgaacgagctgcccgagagcctcgagaccctgatgctggtggccctcctgggcgccatgaccgccgggatcttcctgttcttcatgcagggcaaggggatcggcaagctctccatgggcctgatcgcgatcgccgtggccagcgggctgctctgggtcgccgagatccagccgcagtggatcgccgcgtccatcatcctggagttcttcctgatggtgctcctgatccccgagcccgagaagcagcgcacgccccaggacaaccagctgatctacgtgatcctcaccatcctgaccatcatcggcctgatcgccgccaacgagatggggctcatcgagaagaccaagacggacttcggcttctaccaggtcaagaccgagaccaccatcctggacgtggacctgcggccggccagcgcctggacgctctacgcggtggccaccaccatcctgacccccatgctgcgccacacgatcgagaacaccagcgccaacctctccctggccgccatcgcgaaccaggccgccgtcctgatggggctcggcaagggctggcccctgcaccggatggacctgggggtgcccctcctggccatgggctgctacagccaggtgaacccgaccaccctgacggcctccctcgtcatgctgctggtgcactacgcgatcatcgggcccggcctccaggccaaggccacccgcgaggcccagaagcggaccgcggccggcatcatgaagaaccccaccgtggacgggatcacggtcatcgacctggagcccatcagctacgacccgaagttcgagaagcagctgggccaggtgatgctcctggtgctgtgcgtcgggcagctcctgctgatgcgcaccacctgggccctctgcgaggtgctgaccctggccacgggccccgtgatgaccctctgggaggggaaccccggccggttctggaacaccaccatcgccgtctccacggcgaacatcttccgcggcagctacctggccggggccggcctggccttctccctcatcaagaacgcccagacgccccggcgcgggaccggcaccacgggggagaccctgggcgagaagtggaagcggcagctgaacagcctcgaccgcaaggagttcgaggagtacaagcggtccggcatcctggaggtggaccgcaccgaggccaagagcgccctgcgggacgggtccaagatcaagtacgccgtgagccgcggctccagcaagatccggtggatcgtcgagcgcgggatgatcaagccgaagggcaaggtggtggacctcgggtgcggccggggcgggtggtcctactacatggccaccctgaagaacgtcaccgaggtgaagggctacacgaagggcggccccgggcacgaggagcccatccccatggccacctacggctggaacctggtgaagctccacagcggcgtcgacgtgttctacaagccgaccgagcaggtcgacaccctgctgtgcgacatcggggagtccagctccaaccccacgatcgaggagggccgcaccctccgcgtcctgaagatggtggagccctggctgagcagcaagcccgagttctgcatcaaggtcctcaacccgtacatgcccaccgtgatcgaggagctggagaagctgcagcggcgccacgggggctccctcgtgcggtgccccctgagccgcaactccacccacgagatgtactgggtcagcggcgcgtccgggaacatcgtgagctccgtgaacacgatcagcaagatgctgctgaaccggttcaccacccgccaccggaagcccacctacgagaaggacgtcgacctcggcgccgggacgcgctccgtgagcaccgagaccgagaagccggacatgaccatcatcggccggcgcctgcagcggctgcgcgaggagcacaaggagacgtggcactacgaccaggagaacccctaccggacctgggcctaccacgggtcctacgaggcccccagcaccggctccgcgagctccatggtgaacggcgtcgtgaagctcctgaccaagccgtgggacgtgatccccatggtcacgcagctggccatgaccgacaccacccccttcgggcagcagcgcgtgttcaaggagaaggtggacacgcggacgccccagccgaagcccggcacccgcatgatcatgaccacgaccgccaactggctctgggccctgctggggaagaagaagtccccgcggctctgcacccgcgaggagttcatctccaaggtccggagcaacgccgcgatcggcgccgtgttccaggaggagcaggggtggacctccgccagcgaggccgtgaacgacagccgcttctgggagctggtcgacaaggagcgggccctgcaccaggagggcaagtgcgagtcctgcgtgtacaacatgatgggcaagcgcgagaagaagctcggggagttcggccgcgcgaaggggagccgggccatctggtacatgtggctgggcgcccgcttcctggagttcgaggccctcgggttcctgaacgaggaccactggttctcccgggagaacagctggtccggcgtggagggcgaggggctgcaccgcctcggctacatcctggaggacatcgacaagaaggacggggacctgatctacgccgacgacacggcgggctgggacacccggatcaccgaggacgacctcctgaacgaggagctgatcaccgagcagatggcgccccaccacaagacgctcgccaaggccatcttcaagctgacctaccagaacaaggtcgtgaaggtgctgcgccccacccccaagggcgcggtcatggacatcatcagccggaaggaccagcgcgggtccggccaggtggggacctacggcctcaacaccttcacgaacatggaggtgcagctgatccggcagatggaggccgagggggtcatcacccaggacgacatgcagaaccccaagggcctgaaggagcgcgtggagaagtggctcaaggagtgcggcgtggaccggctgaagcgcatggccatcagcggggacgactgcgtcgtgaagcccctggacgagcggttctccaccagcctcctgttcctgaacgacatgggcaaggtgcgcaaggacatcccgcagtgggagccctccaaggggtggaagaactggcaggaggtccccttctgcagccaccacttccacaagatcttcatgaaggacggccggtccctcgtggtgccctgccgcaacccggacgagctgatcgggcgggcccgcatcagccagggcgccggctggtccctgcgggagaccgcgtgcctcgggaaggcctacgcccagatgtggagcctgatgtacttccaccgccgcgacctgcggctcgcctccatggccatctgcagcgcggtccccacggagtggttccccaccagccgcaccacctggtccatccacgcccaccaccagtggatgacgaccgaggacatgctgaaggtgtggaaccgggtgtggatcgaggacaaccccaacatgaccgacaagaccccggtccacagctgggaggacatcccctacctgggcaagcgcgaggacctctggtgcgggtccctgatcggcctgagctcccgggccacgtgggccaagaacatccacaccgccatcacccaggtgcgcaacctcatcgggaaggaggagtacgtggactacatgcccgcgatgaagcggtacagcgcccccttcgagtccgagggcgtcctgtga

SEQ ID NO: 10490 - RNA, 9867 nt, synthetic construct
  misc_feature 1..9867: note = derived and/or modified CDS sequence (opt1) from DENV-4__KC762697__SS-prME
  source 1..9867: mol_type = other RNA
agcaccatgaccctgctctgcctgatccccaccgccatggccttccacctgagcacccgggacggcgagccgctcatgatcgtggcgaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgtccatcagcaacatcacgaccgccacccgctgcccgacccagggggagccctacctcaaggaggagcaggaccagcagtacatctgccggcgcgacgtggtggaccggggctgggggaacggctgcggcctgttcgggaagggcggggtcgtgacgtgcgccaagttcctgtgctccggcaagatcaccgggaacctcgtgcagatcgagaacctggagtacaccgtcgtggtgaccgtccacaacggcgacacgcacgccgtgggcaacgacaccagcaaccacggggtcaccgccaccatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggaccgcgggcgccgacaccagcgaggtgcactggaactacaaggagcgcatggtgacgttcaaggtcccgcacgccaagcggcaggacgtgaccgtgctggggtcccaggagggcgccatgcacagcgccctggcgggcgccaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgccggggcgccctgcaaggtgcccatcgagatccgggacgtcaacaaggagaaggtggtgggccgcatcatcagctccacccccttcgccgagaacacgaacagcgtcaccaacatcgagctggagccgcccttcggggactcctacatcgtgatcggcgtgggcgacagcgccctcaccctgcactggttccggaaggggtccagcatcggcaagatgttcgagtccacctaccgcggggccaagcggatggcgatcctgggcgagacggcctgggacttcgggagcgtcggcggcctcttcacctccctggggaaggccgtgcaccaggtgttcggcagcgtctacaccaccatgttcgggggcgtgtcctggatgatccgcatcctgatcgggctcctggtgctgtggatcggcacgaacagccggaacacctccatggccatgacctgcatcgccgtcggcgggatcaccctgttcctcggcttcacggtgcaggcggacatggggtgcgtggtcagctggaacggcaaggagctgaagtgcgggtccggcatcttcgtggtggacaacgtccacacctggaccgagcagtacaagttccagcccgagagccccgcccgcctggccagcgccatcctcaacgcccacaaggacggcgtgtgcgggatccggtccaccacgcgcctggagaacgtgatgtggaagcagatcaccaacgagctgaactacgtcctctgggagggcgggcacgacctgaccgtggtggcgggcgacgtcaagggcgtgctgaccaaggggaagcgggtgctcacgccgcccgtcaacgacctgaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttctccaccaacatctggatgaagttccgggagggcagctccgaggtgtgcgaccaccgcctcatgagcgccgcgatcaaggaccagaaggccgtccacgccgacatgggctactggatcgagtccagcaagaaccagacctggcagatcgagaaggcctccctgatcgaggtgaagacctgcctgtggcccaagacgcacaccctctggagcaacggggtgctggagtcccagatgctgatcccccggagctacgcgggcccgttctcccagcacaactaccgccaggggtacgccacccagatcgccggcccctggcacctcgggaagctggagatcgacttcggcgagtgccccggcaccaccgtcacgatccaggaggactgcgaccaccgggggcccagcctgcgcaccaccaccgcctccggcaagctcgtgacgcagtggtgctgccgcagctgcaccatgccgcccctgcggttcctgggggaggacggctgctggtacgggatggagatccgccccctcagcgagaaggaggagaacatggtgaagtcccaggtcaccgccggccagggcaccagcgagacgttctccatggggctgctgtgcctcaccctgttcgtggaggagtgcctgcggcgccgggtcacccgcaagcacatgatcctcgtggtggcgatcaccttctgcgccatcatcctgggcgggctgacgtggatggacctcctgcgggccctgatcatgctcggcgacaccatgagcggccgcatcgggggccagatccacctggccatcatggccgtcttcaagatgtcccccgggtacgtgctgggcgtgttcctccggaagctgaccagccgcgagaccgcgctgatggtcatcgggatggccatgacgaccgtgttctccatcccgcacgacctcatggagctgatcgacggcatcagcctgggcctcatcctgctgaagatcgtgacccacttcgacgacacccaggtcgggacgctcgccctgtccctgaccttcatccggagcaccacgcccctggtgatggcctggcgcacgatcatggccgtgttcttcatggtcaccctgatccccctgtgccggacctcctgcctccagaagcagagccactgggtggagatcaccgcgctgatcctgggcgcccaggccctccccgtgtacctgatgacgctgatgaagggggcctcccgccggagctggccgctcaacgagggcatcatggcggtcgggctggtgtccctgctcggcagcgccctgctgaagaacgacgtgcccctcgccggccccatggtcgccgggggcctgctgctcgccgcgtacgtgatgtccgggagctccgccgacctgagcctggagaaggccgccaacgtgcagtgggacgagatggccgacatcaccggcagctcccccatcatcgaggtcaagcaggacgaggacgggagcttctccatccgcgacgtggaggagaccaacatgatcaccctcctggtgaagctggcgctcatcacggtcagcggcctgtacccgctggccatccccgtgaccatggccctctggtacatctggcaggtcaagacccagcggtccggcgccctgtgggacgtccccagccccgccgcgacccagaaggccacgctgtccgagggggtgtaccgcatcatgcagcggggcctcttcgggaagacccaggtgggcgtcgggatccacatggagggcgtgttccacaccatgtggcacgtgacccgcggcagcgtcatctgccacgagaccgggcggctggagccgtcctgggccgacgtgcgcaacgacatgatcagctacggcgggggctggcgcctgggcgacaagtgggacaaggaggaggacgtgcaggtcctcgccatcgagcccgggaagaaccccaagcacgtgcagacgaagcccggcctgttcaagaccctgaccggggagatcggcgccgtgaccctcgacttcaagccggggacgtccggcagccccatcatcaacaagaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccacccgggcgccggcaagacgaagcgcatcctgccctccatcgtgcgggaggccctgaagcgccggctccgcaccctgatcctggcgcccacccgggtcgtggccgccgagatggaggaggccctgcgcgggctccccatccggtaccagaccccggccgtgaaggcggagcacacgggccgcgagatcgtcgacctgatgtgccacgccaccttcaccacccggctgctcagctccacgcgcgtgcccaactacaacctgatcgtgatggacgaggcccacttcaccgacccctgcagcgtcgccgcccgggggtacatctccacccgcgtggagatgggcgaggcggccgccatcttcatgaccgccacgcccccggggagcaccgaccccttcccccagagcaactcccccatcgaggacatcgagcgggagatcccggagcgcagctggaacaccggcttcgactggatcaccgactaccagggcaagacggtctggttcgtgccctccatcaaggccgggaacgacatcgcgaactgcctgcgcaagagcggcaagcgcgtgatccagctctcccgcaagaccttcgacaccgagtaccccaagaccaagctgacggactgggacttcgtcgtgaccaccgacatcagcgagatgggggccaacttccgggccggccgcgtgatcgacccccggcgctgcctgaagccggtcatcctcaccgacgggcccgagcgggtgatcctggccggccccatccccgtgacgccggcgtccgccgcccagcgccggggccgcatcgggcggaaccccgcccaggaggacgaccagtacgtcttcagcggcgaccccctgaagaacgacgaggaccacgcccactggaccgaggcgaagatgctcctggacaacatctacacccccgaggggatcatcccgaccctgttcggccccgagcgcgagaagacgcaggccatcgacggcgagttccggctccgcggggagcagcggaagaccttcgtggagctgatgcgccggggcgacctgcccgtgtggctctcctacaaggtcgccagcgccgggatctcctacaaggaccgcgagtggtgcttcaccggcgagcggaacaaccagatcctggaggagaacatggaggtggagatctggacccgcgagggggagaagaagaagctgcggcccaagtggctcgacgcccgcgtgtacgcggacccgatggccctgaaggacttcaaggagttcgccagcggccggaagtccatcacgctggacatcctcaccgagatcgccaccctgcccacctacctgagctccaaggccaagctcgcgctggacaacatcgtcatgctgcacaccacggagaagggcgggcgcgcctaccagcacgccctcaacgagctgcccgagagcctggagaccctcatgctggtggccctgctcggcgcgatgaccgccgggatcttcctgttcttcatgcagggcaaggggatcggcaagctgtccatgggcctcatcgccatcgccgtggccagcgggctgctgtgggtcgcggagatccagccgcagtggatcgccgcctccatcatcctcgagttcttcctgatggtgctgctcatccccgagcccgagaagcagcgcacgccccaggacaaccagctgatctacgtgatcctgacgatcctcaccatcatcggcctgatcgccgccaacgagatggggctgatcgagaagaccaagaccgacttcggcttctaccaggcgaagacggagaccaccatcctcgacgtcgacctgcggccggccagcgcctggaccctgtacgccgtggccacgaccatcctcacccccatgctgcgccacaccatcgagaacacgagcgcgaacctgtccctcgccgccatcgccaaccaggccgcggtgctgatggggctgggcaagggctggcccctccaccggatggacctgggggtccccctgctcgccatgggctgctacagccaggtgaacccgaccaccctgaccgcctccctggtgatgctcctggtccactacgccatcatcgggcccggcctgcaggcgaaggccacgcgcgaggcccagaagcggaccgccgccggcatcatgaagaaccccaccgtggacgggatcaccgtgatcgacctcgagcccatcagctacgacccgaagttcgagaagcagctgggccaggtcatgctgctcgtgctgtgcgtggggcagctgctcctgatgcgcacgacctgggcgctgtgcgaggtcctcaccctggccaccggccccatcatgacgctgtgggaggggaaccccggccggttctggaacaccaccatcgccgtgtccaccgccaacatcttccgcggcagctacctcgccggggcgggcctggccttctccctgatcaagaacgcccagacgccccggcgcgggaccggcaccaccggggagacgctcggcgagaagtggaagcggcagctgaacagcctggaccgcaaggagttcgaggagtacaagcggtccggcatcctcgaggtggaccgcaccgaggccaagagcgccctgcgggacgggtccaagatcaagtacgcggtcagccgcggctccagcaagatccggtggatcgtggagcgcgggatggtgaagccgaagggcaaggtcgtggacctggggtgcggccggggcgggtggtcctactacatggccaccctcaagaacgtgaccgaggtcaagggctacaccaagggcggccccgggcacgaggagcccatccccatggccacgtacggctggaacctggtgaagctgcacagcggcgtggacgtcttctacaagccgaccgagcaggtcgacaccctcctgtgcgacatcggggagtccagctccaaccccaccatcgaggagggccgcacgctgcgcgtgctcaagatggtcgagccctggctgagcagcaagcccgagttctgcatcaaggtgctgaacccgtacatgcccaccgtgatcgaggagctcgagaagctgcagcggcgccacgggggctccctggtccggtgccccctgagccgcaactccacccacgagatgtactgggtgagcggcgcctccgggaacatcgtcagctccgtgaacaccatcagcaagatgctcctgaaccggttcacgacccgccaccggaagcccacctacgagaaggacgtggacctgggcgcggggacccgctccgtcagcacggagaccgagaagccggacatgaccatcatcggccggcgcctccagcggctgcgcgaggagcacaaggagacctggcactacgaccaggagaacccctaccggacgtgggcctaccacgggtcctacgaggcccccagcaccggctccgccagctccatggtgaacggcgtggtcaagctgctcaccaagccgtgggacgtgatccccatggtgacccagctggccatgacggacaccacccccttcgggcagcagcgcgtcttcaaggagaaggtggacacccggacgccccagccgaagcccggcacccgcatgatcatgaccaccacggcgaactggctgtgggccctcctggggaagaagaagtccccgcggctgtgcacccgcgaggagttcatctccaaggtgcggagcaacgccgccatcggcgccgtcttccaggaggagcaggggtggacctccgcgagcgaggccgtgaacgacagccgcttctgggagctcgtggacaaggagcgggccctgcaccaggagggcaagtgcgagtcctgcgtctacaacatgatgggcaagcgcgagaagaagctgggggagttcggccgcgccaaggggagccgggccatctggtacatgtggctcggcgcgcgcttcctggagttcgaggccctggggttcctcaacgaggaccactggttctcccgggagaacagctggtccggcgtggagggcgaggggctgcaccgcctgggctacatcctcgaggacatcgacaagaaggacggggacctgatctacgccgacgacaccgccggctgggacacgcggatcaccgaggacgacctgctcaacgaggagctgatcaccgagcagatggcgccccaccacaagaccctggccaaggccatcttcaagctcacgtaccagaacaaggtggtcaaggtgctgcgccccacccccaagggcgccgtgatggacatcatcagccggaaggaccagcgcgggtccggccaggtcgggacctacggcctgaacaccttcaccaacatggaggtgcagctcatccggcagatggaggccgagggggtgatcacgcaggacgacatgcagaaccccaagggcctggaggagcgcgtcgagaagtggctgaaggagtgcggcgtggaccggctcaagcgcatggcgatcagcggggacgactgcgtggtcaagcccctggacgagcggttctccaccagcctcctcttcctgaacgacatgggcaaggtgcgcaaggacatcccgcagtgggagccctccaaggggtggaagaactggcaggaggtgcccttctgcagccaccacttccacaagatcttcatgaaggacggccggtccctggtcgtgccctgccgcaaccaggacgagctcatcgggcgggcccgcatcagccagggcgccggctggtccctgcgggagaccgcctgcctggggaaggcctacgcgcagatgtggagcctcatgtacttccaccgccgcgacctgcggctggcctccatggccatctgcagcgccgtgccgaccgagtggttccccacgagccgcaccacctggtccatccacgcccaccaccagtggatgaccacggaggacatgctcaaggtctggaaccgggtgtggatcgaggacaaccccaacatgaccgacaagacccccatccacagctgggaggacatcccgtacctgggcaagcgcgaggacctgtggtgcgggtccctcatcggcctgagctcccgggcgacctgggccaagaacatccacacggccatcacccaggtgcgcaacctgatcgggaaggaggagtacgtcgactacatgcccgtgatgaagcggtacagcgccccctccgagagcgagggcgtgctctga

SEQ ID NO: 10491 - RNA, 9867 nt, synthetic construct
  misc_feature 1..9867: note = derived and/or modified CDS sequence (opt1) from DENV-4__KC762698__SS-prME
  source 1..9867: mol_type = other RNA
agcaccatgaccctgctctgcctgatccccaccgtgatggccttccacctgagcacccgggacggcgagccgctcatgatcgtggccaagcacgagcgggggcggcccctgctgttcaagaccaccgagggcatcaacaagtgcaccctcatcgccatggacctgggggagatgtgcgaggacaccgtgacctacaagtgccccctgctcgtgaacaccgagcccgaggacatcgtgtgctggtgcaacctgaccagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtcgccccctcctacggcatgcggtgcgtgggcgtggggaaccgcgacttcgtcgagggcgtgagcgggggcgcgtgggtggacctcgtcctggagcacggcgggtgcgtgaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtcgtggaccggggctgggggaacggctgcggcctgttcgggaagggcggggtggtcacgtgcgccaagttcctgtgctccggcaagatcaccgggaacctcgtgcagatcgagaacctggagtacaccgtggtcgtgaccgtccacaacggcgacacgcacgccgtgggcaacgacaccagcaaccacggggtgaccgccaccatcacgccccgctcccccagcgtcgaggtgaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtccactggaactacaaggagcgcatggtgacgttcaaggtgccgcacgccaagcggcaggacgtcaccgtgctggggtcccaggagggcgccatgcacagcgccctggccggcgcgaccgaggtggacagcggggacggcaaccacatgttcgccgggcacctcaagtgcaaggtccgcatggagaagctgcgcatcaagggcatgtcctacaccatgtgcagcggcaagttctccatcgacaaggagatggccgagacgcagcacgggaccaccgtggtgaaggtcaagtacgagggcgccggggccccctgcaaggtgcccatcgagatccgggacgtgaacaaggagaaggtcgtgggccgcatcatcagctccacccccttcgcggagaacacgaacagcgtgaccaacatcgagctggagccgcccttcggggactcctacatcgtcatcggcgccggcgacagcgccctcaccctgcactggttccggaaggggtccagcatcggcaagatgttcgagtccacctaccgcggggccaagcggatggcgatcctgggcgagacggcctgggacttcgggagcgtgggcggcctcttcacctccctggggaaggccgtgcaccaggtcttcggcagcgtgtacaccaccatgttcgggggcgtgtcctggatgatccgcatcctgatcgggttcctcgtcctgtggatcggcacgaacagccggaacacctccatggccatgacctgcatcgccgtgggcgggatcaccctgttcctgggcttcacggtgcaggcggacatggggtgcgtcgtgagctggaacggcaaggagctcaagtgcgggtccggcatcttcgtggtcgacaacgtgcacacctggaccgagcagtacaagttccagcccgagagccccgcccgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgcgggcgacgtgaagggcgtgctgaccaaggggaagcgggccctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgcggccatcaaggaccagaaggccgtccacgccgacatgggctactggatcgagagctccaagaaccagacctggcagatcgagaaggcgagcctcatcgaggtgaagacgtgcctgtggcccaagacccacaccctgtggtccaacggggtgctcgagagccagatgctgatcccccggtcctacgccggcccgttcagccagcacaactaccgccaggggtacgccacccagaccgccggcccctggcacctggggaagctcgagatcgacttcggcgagtgccccggcacgaccgtcaccatccaggaggactgcgaccaccgggggccctccctgcgcaccacgaccgccagcggcaagctggtgacccagtggtgctgccgctcctgcaccatgccgcccctccggttcctgggggaggacggctgctggtacgggatggagatccgccccctgagcgagaaggaggagaacatggtcaagagccaggtcacggcgggccagggcacctccgagaccttcagcatggggctcctgtgcctgaccctcttcgtggaggagtgcctgcggcgccgggtcacgcgcaagcacatgatcctggtggtggtcatcaccttctgcgccatcatcctcggcgggctgacctggatggacctgctccgggccctgatcatgctgggcgacaccatgtccggccgcatcgggggccagatccacctcgccatcatggccgtgttcaagatgagccccgggtacgtgctgggcgtcttcctgcggaagctcacgtcccgcgagaccgcgctgatggtgatcgggatggccatgaccaccgtgttcagcatcccgcacgacctgatggagctcatcgacggcatctccctgggcctgatcctcctgaagatcgtcacgcacttcgacaacacccaggtggggaccctggccctcagcctgaccttcatccggtccacgacgcccctggtgatggcctggcgcaccatcatggccgtcttcttcgtggtgaccctcatccccctgtgccggacgagctgcctgcagaagcagtcccactgggtcgagatcaccgcgctcatcctgggcgcccaggccctgcccgtgtacctcatgaccctgatgaagggggccagccgccggtcctggccgctgaacgagggcatcatggcggtggggctcgtcagcctgctgggctccgccctcctgaagaacgacgtgcccctggccggccccatggtggccgggggcctcctgctggccgcgtacgtcatgagcgggtccagcgccgacctctccctggagaaggccgccaacgtgcagtgggacgagatggccgacatcaccggcagcagccccatcatcgaggtgaagcaggacgaggacgggtccttcagcatccgcgacgtcgaggagacgaacatgatcaccctgctcgtgaagctggcgctgatcaccgtgtccggcctctacccgctggccatccccgtcaccatggccctgtggtacgtgtggcaggtcaagacgcagcggagcggcgccctctgggacgtcccctcccccgccgcgacccagaaggccaccctgagcgagggggtgtaccgcatcatgcagcggggcctgttcgggaagacccaggtgggcgtcgggatccacatggagggcgtgttccacaccatgtggcacgtgacgcgcggctccgtcatctgccacgagaccgggcggctcgagccgagctgggccgacgtgcgcaacgacatgatctcctacggcgggggctggcgcctgggcgacaagtgggacaaggaggaggacgtgcaggtcctggccatcgagcccgggaagaaccccaagcacgtgcagaccaagcccggcctcttcaagaccctgacgggggagatcggcgccgtgaccctggacttcaagccggggaccagcggctcccccatcatcaacaagaagggcaaggtcatcgggctctacggcaacggggtggtgaccaagagcggcgactacgtctccgcgatcacgcaggccgagcggatcggggagcccgactacgaggtggacgaggacatcttccgcaagaagcggctgaccatcatggacctgcacccgggcgccggcaagaccaagcgcatcctccccagcatcgtgcgggaggccctgaagcgccggctgcgcaccctcatcctggcgcccacgcgggtcgtggccgccgagatggaggaggccctgcgcgggctgcccatccggtaccagaccccggccgtgaagtccgagcacaccggccgcgagatcgtcgacctcatgtgccacgcgaccttcacgacccggctgctgagctccacccgcgtgcccaactacaacctcatcgtcatggacgaggcccacttcaccgacccctgcagcgtggccgcccgggggtacatctccacgcgcgtggagatgggcgaggccgcggccatcttcatgaccgccacgcccccggggagcatcgaccccttcccccagagcaactcccccatcgaggacatcgagcgggagatcccggagcgcagctggaacaccggcttcgactggatcacggactaccagggcaagaccgtctggttcgtgccctccatcaaggccgggaacgacatcgccaactgcctgcgcaagagcggcaagaaggtgatccagctgtcccgcaagaccttcgacaccgagtaccccaagacgaagctcaccgactgggacttcgtcgtgaccaccgacatcagcgagatgggggcgaacttccgcgccggccgggtgatcgacccccgccggtgcctgaagccggtcatcctgacggacgggcccgagcgcgtgatcctcgccggccccatccccgtgaccccggcctccgcggcccagcggcgcggccggatcgggcgcaaccccgcccaggaggacgaccagtacgtcttcagcggcgaccccctgaagaacgacgaggaccacgcccactggaccgaggccaagatgctgctcgacaacatctacacccccgaggggatcatcccgacgctgttcggccccgagcgggagaagacccaggcgatcgacggcgagttccgcctgcgcggggagcagcgcaagaccttcgtggagctcatgcggcgcggcgacctgcccgtgtggctgtcctacaaggtcgccagcgccgggatctcctacaaggaccgggagtggtgcttcaccggcgagcgcaacaaccagatcctcgaggagaacatggaggtggagatctggacgcgggagggggagaagaagaagctgcgccccaagtggctggacgcccgggtgtacgccgacccgatggcgctcaaggacttcaaggagttcgccagcggccgcaagtccatcaccctggacatcctgaccgagatcgccaccctccccacctacctgagctccaaggccaagctggccctcgacaacatcgtcatgctgcacacgaccgagaagggcgggcgggcgtaccagcacgccctgaacgagctccccgagagcctggagaccctgatgctcgtggccctgctgggcgccatgaccgcggggatcttcctcttcttcatgcagggcaaggggatcggcaagctgtccatgggcctgatcgccatcgccgtggccagcgggctcctgtgggtcgccgagatccagccgcagtggatcgcggcctccatcatcctggagttcttcctcatggtgctgctgatccccgagcccgagaagcagcgcacgccccaggacaaccagctcatctacgtgatcctgaccatcctgaccatcatcggcctcatcgccgccaacgagatggggctgatcgagaagaccaagacggacttcggcttctaccaggtcaagaccgagaacaccatcctggacgtggacctccgcccggccagcgcgtggaccctgtacgccgtggccacgaccatcctgacccccatgctccggcacaccatcgagaacacgagcgccaacctgtccctggccgcgatcgccaaccaggccgccgtcctcatggggctgggcaagggctggcccctgcaccgcatggacctcggggtgcccctgctggccatgggctgctacagccaggtgaacccgaccaccctcaccgcgtccctggtcatgctgctcgtgcactacgccatcatcgggcccggcctgcaggccaaggccacgcgggaggcgcagaagcgcaccgccgccggcatcatgaagaaccccaccgtggacgggatcaccgtcatcgacctggagcccatcagctacgacccgaagttcgagaagcagctcggccaggtgatgctgctggtgctctgcgtcgggcagctgctgctcatgcggacgacctgggccctgtgcgaggtgctgaccctcgccaccggccccgtgatgacgctgtgggaggggaaccccggccgcttctggaacaccaccatcgcggtctccaccgccaacatcttccggggcagctacctggccggggccggcctcgccttctccctgatcaagaacgcgcagacgccccgccgggggaccggcaccaccggggagacgctgggcgagaagtggaagcgccagctcaacagcctggaccggaaggagttcgaggagtacaagcgctccggcatcctggaggtggaccggaccgaggccaagagcgccctccgcgacgggtccaagatcaagtacgccgtgagccggggctccagcaagatccgctggatcgtcgagcgggggatgatcaagccgaagggcaaggtggtggacctggggtgcggccgcggcgggtggtcctactacatggccaccctgaagaacgtcaccgaggtgaagggctacaccaagggcggccccgggcacgaggagcccatccccatggcgacgtacggctggaacctcgtgaagctgcacagcggcgtcgacgtgttctacaagccgaccgagcaggtcgacaccctgctctgcgacatcggggagtccagctccaaccccaccatcgaggagggccggacgctgcgcgtcctgaagatggtggagccctggctcagcagcaagcccgagttctgcatcaaggtcctgaacccgtacatgcccaccgtgatcgaggagctggagaagctccagcgccggcacgggggctccctggtgcgctgccccctgagccggaactccacccacgagatgtactgggtcagcggcgcctccgggaacatcgtgagctccgtgaacaccatcagcaagatgctgctcaaccgcttcacgacccggcaccgcaagcccacctacgagaaggacgtcgacctgggcgccgggacccggtccgtgagcacggagatcgagaagccggacatgaccatcatcggccgccggctgcagcgcctccgggaggagcacaaggagacctggcactacgaccacgagaacccctaccgcacctgggcctaccacgggtcctacgaggcgcccagcacgggctccgccagctccatggtgaacggcatcgtcaagctgctgaccaagccgtgggacgtgatccccatggtgacccagctcgccatgaccgacacgacccccttcgggcagcagcgggtcttcaaggagaaggtggacacccgcacgccccagccgaagcccggcacgcggatgatcatgaccaccaccgccaactggctgtgggccctgctcgggaagaagaagtccccgcgcctgtgcacgcgggaggagttcatctccaaggtgcgcagcaacgcggccatcggcgccgtcttccaggaggagcaggggtggacctccgccagcgaggccgtgaacgacagccggttctgggagctggtggacaaggagcgcgcgctccaccaggagggcaagtgcgagtcctgcgtctacaacatgatgggcaagcgggagaagaagctgggggagttcggccgcgccaaggggagccgcgccatctggtacatgtggctgggcgcccggttcctcgagttcgaggccctggggttcctgaacgaggaccactggttctcccgcgagaacagctggtccggcgtggagggcgaggggctccaccggctgggctacatcctggaggacatcgacaagaaggacggggacctcatctacgcggacgacaccgccggctgggacacccgcatcacggaggacgacctgctgaacgaggagctcatcaccgagcagatggcgccccaccacaagaccctggccaaggcgatcttcaagctgacctaccagaacaaggtggtcaaggtgctccggcccacgcccaagggcgccgtgatggacatcatcagccgcaaggaccagcgggggtccggccaggtcgggacctacggcctgaacaccttcaccaacatggaggtgcagctgatccgccagatggaggccgagggggtgatcacccaggacgacatgcagaaccccaagggcctcaaggagcgggtcgagaagtggctgaaggagtgcggcgtggaccgcctggagcggatggccatcagcggggacgactgcgtggtcaagcccctcgacgagcgcttctccacgagcctgctgttcctcaacgacatgggcaaggtgcggaaggacatcccgcagtgggagccctccaaggggtggaagaactggcaggaggtgcccttctgcagccaccacttccacaagatcttcatgaaggacggccgctccctggtcgtgccctgccggaaccaggacgagctgatcgggcgcgcccggatcagccagggcgcgggctggtccctccgcgagaccgcctgcctggggaaggcctacgcccagatgtggctgctcatgtacttccaccggcgcgacctgcgcctggccagcatggcgatctgctccgccgtgccgaccgagtggttccccaccagccggacgacctggagcatccacgcccaccaccagtggatgaccaccgaggacatgctcaaggtctggaaccgcgtgtggatcgaggacaaccccaacatgacggacaagacccccgtgcactcctgggaggacatcccgtacctgggcaagcgggaggacctgtggtgcgggagcctcatcggcctgtccagccgcgccacctgggccaagaacatccacaccgcgatcacgcaggtccggaacctgatcgggaaggaggagtacgtggactacatgcccgccatgaagcgctactccgcccccttcgagagcgagggcgtgctctga

SEQ ID NO: 10492 - RNA, 9867 nt, synthetic construct
  misc_feature 1..9867: note = derived and/or modified CDS sequence (opt1) from DENV-4__KC762699__SS-prME
  source 1..9867: mol_type = other RNA
agcaccatgaccctgctctgcctgatccccaccgtgatggccttccacctgagcacccgggacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatcagctccacccccttcgcggagaacacgaacagcgtgaccaacatcgagctggagccgcccttcggggactcctacatcgtgatcggcgtcggcgacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtgcaccaggtcttcggcagcgtgtacaccaccatgttcgggggcgtgtcctggatgatccgcatcctgatcgggttcctcgtcctgtggatcggcacgaacagccggaacacctccatggccatgacctgcatcgccgtgggcgggatcaccctgttcctgggcttcacggtgcaggccgacatggggtgcgtcgtgagctggaacggcaaggagctcaagtgcgggtccggcatcttcgtggtcgacaacgtgcacacctggaccgagcagtacaagttccagcccgagagccccgcgcgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgccggcgacgtgaagggcgtgctgaccaaggggaagcgggcgctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctcatcgaggtgaagacgtgcctgtggcccaagacccacaccctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcacgaccgtcaccatccaggaggactgcgaccaccgggggccctccctgcgcaccacgaccgccagcggcaagctggtgacccagtggtgctgccgctcctgcaccatgccgcccctccggttcctgggggaggacggctgctggtacgggatggagatccgccccctgagcgagaaggaggagaacatggtcaagagccaggtcacggccggccagggcacctccgagaccttcagcatggggctcctgtgcctgaccctcttcgtggaggagtgcctgcggcgccgggtcacgcgcaagcacatgatcctggtggtggtcatcaccttctgcgcgatcatcctcggcgggctgacctggatggacctgctccgggccctgatcatgctgggcgacaccatgtccggccgcatcgggggccagatccacctcgccatcatggccgtgttcaagatgagccccgggtacgtgctgggcgtcttcctgcggaagctcacgtcccgcgagaccgccctgatggtgatcgggatggcgatgaccaccgtgttcagcatcccgcacgagctgatggagctcatcgacggcatctccctgggcctgatcctcctgaagatcgtcacgcacttcgacaacacccaggtggggaccctggccctcagcctgaccttcatccggtccacgacgcccctggtgatggcctggcgcaccatcatggccgtcttcttcgtggtgaccctcatccccctgtgccggacgagctgcctgcagaagcagtcccactgggtcgagatcaccgccctcatcctgggcgcgcaggccctgcccgtgtacctcatgaccctgatgaagggggccagccgccggtcctggccgctgaacgagggcatcatggccgtggggctcgtcagcctgctgggctccgcgctcctgaagaacgacgtgcccctggccggccccatggtggccgggggcctcctgctggccgcctacgtcatgagcgggtccagcgcggacctctccctggagaaggccgccaacgtgcagtgggacgagatggccgacatcaccggcagcagccccatcatcgaggtgaagcaggacgaggacgggtccttcagcatccgcgacgtcgaggagacgaacatgatcaccctgctcgtgaagctggccctgatcaccgtgtccggcctctacccgctggcgatccccgtcaccatggccctgtggtacgtgtggcaggtcaagacgcagcggagcggcgccctctgggacgtcccctcccccgccgccacccagaaggcgaccctgagcgagggggtgtaccgcatcatgcagcggggcctgttcgggaagacccaggtgggcgtcgggatccacatggagggcgtgttccacaccatgtggcacgtgacgcgcggctccgtcatctgccacgagaccgggcggctcgagccgagctgggccgacgtgcgcaacgacatgatctcctacggcgggggctggcgcctgggcgacaagtgggacaaggaggaggacgtgcaggtcctggccatcgagcccgggaagaaccccaagcacgtgcagaccaagcccggcctcttcaagaccctgacgggggagatcggcgccgtgaccctggacttcaagccggggaccagcggctcccccatcatcaacaagaagggcaaggtcatcgggctctacggcaacggggtggtgaccaagagcggcgactacgtctccgccatcacgcaggcggagcggatcggggagcccgactacgaggtggacgaggacatcttccgcaagaagcggctgaccatcatggacctgcacccgggcgccggcaagaccaagcgcatcctccccagcatcgtgcgggaggccctgaagcgccggctgcgcaccctcatcctggcccccacgcgggtcgtggcggccgagatggaggaggccctgcgcgggctgcccatccggtaccagaccccggccgtgaagtccgagcacaccggccgcgagatcgtcgacctcatgtgccacgccaccttcacgacccggctgctgagctccacccgcgtgcccaactacaacctcatcgtcatggacgaggcgcacttcaccgacccctgcagcgtggccgcccgggggtacatctccacgcgcgtggagatgggcgaggccgccgcgatcttcatgaccgccacgcccccggggagcatcgaccccttcccccagagcaactcccccatcgaggacatcgagcgggagatcccggagcgcagctggaacaccggcttcgactggatcacggactaccagggcaagaccgtctggttcgtgccctccatcaaggccgggaacgacatcgccaactgcctgcgcaagagcggcaagcgcgtgatccagctgtcccgcaagaccttcgacaccgagtaccccaagacgaagctcaccgactgggacttcgtcgtgaccaccgacatcagcgagatgggggccaacttccgggcgggccgcgtgatcgacccccggcgctgcctgaagccggtcatcctgacggacgggcccgagcgggtgatcctcgccggccccatccccgtgaccccggcctccgccgcgcagcgccggggccgcatcgggcggaaccccgcccaggaggacgaccagtacgtcttcagcggcgaccccctgaagaacgacgaggaccacgcccactggaccgaggccaagatgctgctcgacaacatctacacccccgaggggatcatcccgacgctgttcggccccgagcgcgagaagacccaggccatcgacggcgagttccggctgcgcggggagcagcggaagaccttcgtggagctcatgcgccggggcgacctgcccgtgtggctgtcctacaaggtcgcgagcgccgggatctcctacaaggaccgcgagtggtgcttcaccggcgagcggaacaaccagatcctcgaggagaacatggaggtggagatctggacgcgcgagggggagaagaagaagctgcggcccaagtggctggacgcccgcgtgtacgccgacccgatggccctcaaggacttcaaggagttcgcgagcggccggaagtccatcaccctggacatcctgaccgagatcgccaccctccccacctacctgagctccaaggccaagctggccctcgacaacatcgtcatgctgcacacgaccgagaagggcgggcgcgcctaccagcacgcgctgaacgagctccccgagagcctggagaccctgatgctcgtggccctgctgggcgccatgaccgccgggatcttcctcttcttcatgcagggcaaggggatcggcaagctgtccatgggcctgatcgcgatcgccgtggccagcgggctcctgtgggtcgccgagatccagccgcagtggatcgccgcgtccatcatcctggagttcttcctcatggtgctgctgatccccgagcccgagaagcagcgcacgccccaggacaaccagctcatctacgtgatcctgaccatcctgaccatcatcggcctcatcgccgccaacgagatggggctgatcgagaagaccaagacggacttcggcttctaccaggtcaagaccgagaccaccatcctggacgtggacctccggccggccagcgcctggacgctgtacgcggtggccaccaccatcctgacccccatgctccgccacacgatcgagaacaccagcgccaacctgtccctggccgccatcgcgaaccaggccgccgtcctcatggggctgggcaagggctggcccctgcaccggatggacctcggggtgcccctgctggccatgggctgctacagccaggtgaacccgaccaccctcacggcctccctggtcatgctgctcgtgcactacgcgatcatcgggcccggcctgcaggccaaggccacccgcgaggcccagaagcggaccgcggccggcatcatgaagaaccccaccgtggacgggatcacggtcatcgacctggagcccatcagctacgacccgaagttcgagaagcagctcggccaggtgatgctgctggtgctctgcgtcgggcagctgctgctcatgcgcaccacctgggccctgtgcgaggtgctgaccctcgccacgggccccgtgatgaccctgtgggaggggaaccccggccggttctggaacaccaccatcgccgtctccacggcgaacatcttccgcggcagctacctggccggggccggcctcgccttctccctgatcaagaacgcccagacgccccggcgcgggaccggcaccacgggggagaccctgggcgagaagtggaagcggcagctcaacagcctggaccgcaaggagttcgaggagtacaagcggtccggcatcctggaggtggaccgcaccgaggccaagagcgccctccgggacgggtccaagatcaagtacgccgtgagccgcggctccagcaagatccggtggatcgtcgagcgcgggatgatcaagccgaagggcaaggtggtggacctggggtgcggccggggcgggtggtcctactacatggccaccctgaagaacgtcaccgaggtgaagggctacacgaagggcggccccgggcacgaggagcccatccccatggccacctacggctggaacctcgtgaagctgcacagcggcgtcgacgtgttctacaagccgaccgagcaggtcgacaccctgctctgcgacatcggggagtccagctccaaccccacgatcgaggagggccgcaccctgcgcgtcctgaagatggtggagccctggctcagcagcaagcccgagttctgcatcaaggtcctgaacccgtacatgcccaccgtgatcgaggagctggagaagctccagcggcgccacgggggctccctggtgcggtgccccctgagccgcaactccacccacgagatgtactgggtcagcggcgcgtccgggaacatcgtgagctccgtgaacacgatcagcaagatgctgctcaaccggttcaccacccgccaccggaagcccacctacgagaaggacgtcgacctgggcgccgggacgcgctccgtgagcaccgagaccgagaagccggacatgaccatcatcggccggcgcctgcagcggctccgcgaggagcacaaggagacgtggcactacgaccaggagaacccctaccggacctgggcctaccacgggtcctacgaggcccccagcaccggctccgcgagctccatggtgaacggcgtcgtgaagctgctgaccaagccgtgggacgtgatccccatggtcacgcagctcgccatgaccgacaccacccccttcgggcagcagcgcgtgttcaaggagaaggtggacacgcggacgccccagccgaagcccggcacccgcatgatcatgaccacgaccgccaactggctgtgggccctgctcgggaagaagaagtccccgcggctgtgcacccgcgaggagttcatctccaaggtccggagcaacgccgcgatcggcgccgtgttccaggaggagcaggggtggacctccgccagcgaggccgtgaacgacagccgcttctgggagctggtcgacaaggagcgggccctccaccaggagggcaagtgcgagtcctgcgtgtacaacatgatgggcaagcgcgagaagaagctgggggagttcggccgcgcgaaggggagccgggccatctggtacatgtggctgggcgcccgcttcctcgagttcgaggccctggggttcctgaacgaggaccactggttctcccgggagaacagctggtccggcgtggagggcgaggggctccaccgcctgggctacatcctggaggacatcgacaagaaggacggggacctcatctacgccgacgacacggcgggctgggacacccggatcaccgaggacgacctgctgaacgaggagctcatcaccgagcagatggcgccccaccacaagacgctggccaaggccatcttcaagctgacctaccagaacaaggtcgtgaaggtgctccgccccacccccaagggcgcggtcatggacatcatcagccggaaggaccagcgcgggtccggccaggtggggacctacggcctgaacaccttcacgaacatggaggtgcagctgatccggcagatggaggccgagggggtcatcacccaggacgacatgcagaaccccaagggcctcaaggagcgcgtggagaagtggctgaaggagtgcggcgtggaccggctgaagcgcatggccatcagcggggacgactgcgtcgtgaagcccctcgacgagcggttctccaccagcctgctgttcctcaacgacatgggcaaggtgcgcaaggacatcccgcagtgggagccctccaaggggtggaagaactggcaggaggtccccttctgcagccaccacttccacaagatcttcatgaaggacggccggtccctggtggtgccctgccgcaaccaggacgagctgatcgggcgggcccgcatcagccagggcgccggctggtccctccgggagaccgcgtgcctggggaaggcctacgcccagatgtggagcctgatgtacttccaccgccgcgacctccggctggcctccatggccatctgcagcgcggtcccgacggagtggttccccaccagccgcaccacctggtccatccacgcccaccaccagtggatgacgaccgaggacatgctgaaggtgtggaaccgggtgtggatcgaggacaaccccaacatgaccgacaagacccccgtccacagctgggaggacatcccgtacctcggcaagcgcgaggacctgtggtgcgggtccctgatcggcctcagctcccgggccacgtgggccaagaacatccacaccgccatcacccaggtgcgcaacctgatcgggaaggaggagtacgtggactacatgcccgcgatgaagcggtacagcgcccccttcgagtccgagggcgtcctgtga

SEQ ID NO: 10493 - RNA, 9867 nt, synthetic construct
  misc_feature 1..9867: note = derived and/or modified CDS sequence (opt1) from DENV-4__JQ915085__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatcagctccacccccttcgcggagaacacgaacagcgtgaccaacatcgagctggagccgcccttcggggactcctacatcgtgatcggcgtcggcgacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtgcaccaggtcttcggcagcgtgtacaccaccatgttcgggggcgtgtcctggatcatccgcatcctgatcgggttcctcgtcctgtggatcggcacgaacagccggaacacctccatggccatgacctgcatcgccgtgggcgggatcaccctgttcctgggcttcacggtgcaggccgacatggggtgcgtcgtgagctggaacggcaaggagctcaagtgcgggtccggcatcttcgtggtcgacaacgtgcacacctggaccgagcagtacaagttccagcccgagagccccgcgcgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgccggcgacgtgaagggcgtgctgaccaaggggaagcgggcgctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctcatcgaggtgaagacgtgcctgtggcccaagacccacaccctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcacgaccgtcaccatccaggaggactgcgaccaccgggggccctccctgcgcaccacgaccgccagcggcaagctggtgacccagtggtgctgccgctcctgcaccatgccgcccctccggttcctgggggaggacggctgctggtacgggatggagatccgccccctgagcgagaaggaggagaacatggtcaagagccaggtcacggccggccagggcacctccgagaccttcagcatggggctcctgtgcctgaccctcttcgtggaggagtgcctgcggcgccgggtcacgcgcaagcacatgatcctggtggtggtcatcaccttctgcgcgatcatcctcggcgggctgacctgggtggacctgctccgggccctgatcatgctgggcgacaccatgtccggccgcatcgggggccagatccacctcgccatcatggccgtgttcaagatgagccccgggtacgtcctgggcgtgttcctgcggaagctcacgtcccgcgagaccgccctgatggtgatcgggatggcgatgaccaccgtcttcagcatcccgcgggacctgatggagctcatcgacggcatctccctgggcctgatcctcctgaagatcgtgacgcacttcgacaacacccaggtggggaccctggccctcagcctgaccttcatccgctccacgacgcccctggtcatggcctggcggaccatcatggtggtgttcttcgtcgtgaccctcatccccctgtgccgcacgagctgcctgcagaagcagtcccactgggtggagatcaccgccctcatcctgggcgcccaggcgctgcccgtctacctcatgaccctgatgaagggggccagccggcgctcctggccgctgaacgagggcatcatggccgtggggctcgtgagcctgctgggctccgccctcctgaagaacgacgtccccctggcgggccccatggtggccgggggcctcctgctggccgcctacgtgatgagcgggtccagcgccgacctctccctggagaaggcggccaacgtccagtgggacgagatggccgacatcaccggcagcagccccatcatcgaggtgaagcaggacgaggacgggtccttcagcatccgggacgtggaggagacgaacatgatcaccctgctcgtcaagctggccctgatcaccgtgtccggcctctacccgctggccatccccgtgaccatggcgctgtggtacatctggcaggtcaagacgcagcgcagcggcgccctctgggacgtgccctcccccgccgccatccagaaggccaccctgagcgagggggtgtaccggatcatgcagcgcggcctgttcgggaagacccaggtcggcgtggggatccacatggagggcgtgttccacaccatgtggcacgtcacccggggctccgtgatctgccacgagacggggcgcctcgagccgagctgggcggacgtgcgcaacgacatgatctcctacggcgggggctggcggctgggcgacaagtgggacaaggaggaggacgtccaggtgctggccatcgagcccgggaagaaccccaagcacgtgcagaccaagcccggcctcttcaagaccctgaccggggagatcggcgccgtcacgctggacttcaagccggggaccagcggctcccccatcatcaacaagaagggcaaggtgatcgggctctacggcaacggggtggtcaccaagagcggcgactacgtgtccgccatcacccaggccgagcgcatcggggagcccgactacgaggtggacgaggacatcttccggaagaagcgcctgacgatcatggacctgcacccgggcgcgggcaagaccaagcggatcctccccagcatcgtccgcgaggccctgaagcggcgcctgcggaccctcatcctggcccccacccgcgtggtggccgcggagatggaggaggccctgcgggggctgcccatccgctaccagacgccggccgtcaagtccgagcacaccggccgggagatcgtggacctcatgtgccacgccaccttcaccacgcgcctgctgagctccacccgggtccccaactacaacctcatcgtgatggacgaggcccacttcaccgacccctgcagcgtggcggcccgcgggtacatctccacccgggtcgagatgggcgaggccgccgccatcttcatgacggcgacgcccccggggagcatcgaccccttcccccagagcaactcccccatcgaggacatcgagcgcgagatcccggagcggagctggaacaccggcttcgactggatcaccgactaccagggcaagacggtgtggttcgtgccctccatcaaggccgggaacgacatcgccaactgcctgcgcaagagcggcaagaaggtcatccagctgtcccgcaagaccttcgacaccgagtaccccaagaccaagctcacggactgggacttcgtggtgaccaccgacatcagcgagatgggggccaacttccgggccggccgcgtcatcgacccccggcgctgcctgaagccggtgatcctgaccgacgggcccgagcgggtgatcctcgcgggccccatccccgtcacgccggcctccgccgcccagcgccggggccgcatcgggcggaaccccgcgcaggaggacgaccagtacgtgttcagcggcgaccccctgaagaacgacgaggaccacgcccactggaccgaggccaagatgctgctcgacaacatctacacccccgaggggatcatcccgaccctgttcggccccgagcgcgagaagacgcaggccatcgacggcgagttccggctgcgcggggagcagcggaagaccttcgtggagctcatgcgccggggcgacctgcccgtctggctgtcctacaaggtggccagcgcggggatctcctacaaggaccgcgagtggtgcttcaccggcgagcggaacaaccagatcctcgaggagaacatggaggtggagatctggacccgcgagggggagaagaagaagctgcggcccaagtggctggacgcccgcgtctacgccgacccgatggccctcaaggacttcaaggagttcgccagcggccggaagtccatcacgctggacatcctgaccgagatcgcgaccctccccacctacctgagctccaaggccaagctggccctcgacaacatcgtgatgctgcacaccgccgagaagggcgggcgcgcctaccagcacgcgctgaacgagctccccgagagcctggagacgctgatgctcgtggccctgctgggcgccatgaccgccgggatcttcctcttcttcatgcagggcaaggggatcggcaagctgtccatgggcctgatcgcgatcgccgtcgccagcgggctcctgtgggtggccgagatccagccgcagtggatcgccgcgtccatcatcctggagttcttcctcatggtgctgctgatccccgagcccgagaagcagcgcacgccccaggacaaccagctcatctacgtcatcctgaccatcctgacgatcatcggcctcatcgccgccaacgagatggggctgatcgagaagaccaagaccgacttcggcttctaccaggtgaagaccgagacgaccatcctggacgtggacctccggccggccagcgcctggaccctgtacgcggtcgccaccacgatcctgacccccatgctccgccacaccatcgagaacaccagcgccaacctgtccctggccgccatcgcgaaccaggccgccgtgctcatggggctgggcaagggctggcccctgcaccggatggacctcggggtgcccctgctggccatgggctgctacagccaggtcaacccgacgaccctcaccgcctccctggtgatgctgctcgtgcactacgcgatcatcgggcccggcctgcaggccaaggccacccgcgaggcccagaagcggacggcggccggcatcatgaagaaccccaccgtcgacgggatcaccgtgatcgacctggagcccatcagctacgacccgaagttcgagaagcagctcggccaggtgatgctgctggtcctctgcgtggggcagctgctgctcatgcgcaccacgtgggccctgtgcgaggtgctgaccctcgccaccggccccatcatgaccctgtgggaggggaaccccggccggttctggaacacgaccatcgccgtctccaccgcgaacatcttccgcggcagctacctggccggggccggcctcgccttctccctgatcaagaacgcccagacgccccggcgcgggacgggcaccaccggggagaccctgggcgagaagtggaagcggcagctcaacagcctggaccgcaaggagttcgaggagtacaagcggtccggcatcctggaggtggaccgcacggaggccaagagcgccctccgggacgggtccaagatcaagcacgccgtgagccgcggctccagcaagatccggtggatcgtcgagcgcgggatgatcaagccgaagggcaaggtggtggacctggggtgcggccggggcgggtggtcctactacatggccaccctgaagaacgtcaccgaggtgaagggctacaccaagggcggccccgggcacgaggagcccatccccatggccacctacggctggaacctcgtgaagctgcacagcggcgtcgacgtgttctacaagccgacggagcaggtcgacaccctgctctgcgacatcggggagtccagctccaaccccaccatcgaggagggccgcaccctgcgcgtcctgaagatggtggagccctggctcagcagcaagcccgagttctgcatcaaggtcctgaacccgtacatgcccacggtgatcgaggagctggagaagctccagcggcgccacgggggctccctggtgcggtgccccctgagccgcaactccacccacgagatgtactgggtcagcggcgcgtccgggaacatcgtgagctccgtgaacaccatcagcaagatgctgctcaaccggttcaccacgcgccaccggaagcccacctacgagaaggacgtcgacctgggcgccgggacccgctccgtgagcaccgagacggagaagccggacatgaccatcatcggccggcgcctgcagcggctccgcgaggagcacaaggagacctggcactacgaccaggagaacccctaccggacctgggcctaccacgggtcctacgaggcccccagcacgggctccgcgagctccatggtgaacggcgtcgtgaagctgctgaccaagccgtgggacgtgatccccatggtcacccagctcgccatgaccgacacgacccccttcgggcagcagcgcgtgttcaaggagaaggtggacacccggacgccccagccgaagcccggcacgcgcatgatcatgaccaccaccgccaactggctgtgggccctgctcgggaagaagaagtccccgcggctgtgcacgcgcgaggagttcatctccaaggtccggagcaacgccgcgatcggcgccgtgttccaggaggagcaggggtggacctccgccagcgaggccgtgaacgacagccgcttctgggagctggtcgacaaggagcgggccctccaccaggagggcaagtgcgagtcctgcgtgtacaacatgatgggcaagcgcgagaagaagctgggggagttcggccgcgcgaaggggagccgggccatctggtacatgtggctgggcgcccgcttcctcgagttcgaggccctggggttcctgaacgaggaccactggttctcccgggagaacagctggtccggcgtggagggcgaggggctccaccgcctgggctacatcctggaggacatcgacaagaaggacggggacctcatctacgccgacgacaccgcgggctgggacacccggatcacggaggacgacctgctgaacgaggagctcatcaccgagcagatggcgccccaccacaagaccctggccaaggccatcttcaagctgacctaccagaacaaggtcgtgaaggtgctccgccccacgcccaagggcgcggtcatggacatcatcagccggaaggaccagcgcgggtccggccaggtggggacctacggcctgaacaccttcaccaacatggaggtgcagctgatccggcagatggaggccgagggggtcatcacccaggacgacatgcagaaccccaagggcctcaaggagcgcgtggagaagtggctgaaggagtgcggcgtggaccggctgaagcgcatggccatcagcggggacgactgcgtcgtgaagcccctcgacgagcggttctccacgagcctgctgttcctcaacgacatgggcaaggtgcgcaaggacatcccgcagtgggagccctccaaggggtggaagaactggcaggaggtccccttctgcagccaccacttccacaagatcttcatgaaggacggccggtccctggtggtgccctgccgcaaccaggacgagctgatcgggcgggcccgcatcagccagggcgccggctggtccctccgggagaccgcgtgcctggggaaggcctacgcccagatgtggagcctgatgtacttccaccgccgcgacctccggctggcctccatggccatctgcagcgcggtcccgaccgagtggttccccaccagccgcacgacctggtccatccacgcccaccaccagtggatgaccaccgaggacatgctgaaggtgtggaaccgggtgtggatcgaggacaaccccaacatgacggacaagacccccgtccacagctgggaggacatcccgtacctcggcaagcgcgaggacctgtggtgcgggtccctgatcggcctcagctcccgggccacctgggccaagaacatccacaccgccatcacccaggtgcgcaacctgatcgggaaggaggagtacgtggactacatgcccgcgatgaagcggtacagcgcccccttcgagtccgagggcgtcctgtga

SEQ ID NO: 10494 - RNA, 9867 nt, synthetic construct
  misc_feature 1..9867: note = derived and/or modified CDS sequence (opt1) from DENV-4__JQ915088__SS-prME
  source 1..9867: mol_type = other RNA
agcaccatgaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcatcgtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcacgaccatggcccagggcaagcccaccctggacttcgagctcaccaagacgaccgccaaggaggtggccctgctgcggacctactgcatcgaggcctccatcagcaacatcaccacggcgacccgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcctgtgctccggcaagatcacggggaacctcgtccagatcgagaacctggagtacaccgtggtggtcaccgtgcacaacggcgacacccacgccgtcggcaacgacacgagcaaccacggggtgaccgccaccatcacgccccggtcccccagcgtggaggtcaagctgccggactacggcgagctcacgctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcaccttcaaggtgccgcacgccaagcggcaggacgtgacggtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacccagcacgggacgaccgtcgtgaaggtgaagtacgagggcgccggggccccctgcaagatccccatcgagatccgggacgtcaacaaggagaaggtggtgggccgcatcatcagctccacccccttcgcggagaacaccaacagcgtcatcaacatcgagctggagccgcccttcggggactcctacatcgtgatcggcgtgggcgacagcgccctcacgctgcactggttccggaaggggtccagcatcggcaagatgttcgagtccacctaccgcggggccaagcggatggccatcctgggcgagaccgcgtgggacttcgggagcgtcggcggcctcttcacctccctggggaaggccgtgcaccaggtgttcggcagcgtctacacgaccatgttcgggggcgtgtcctggatgatccgcatcctgatcgggttcctcgtgctgtggatcggcaccaacagccggaacacctccatggccatgacgtgcatcgccgtcggcgggatcaccctgttcctgggcttcaccgtgcaggccgacatggggtgcgtggtcagctggaacggcaaggagctcaagtgcgggtccggcatcttcgtggtggacaacgtccacacctggacggagcagtacaagttccagcccgagagccccgcgcgcctggccagcgccatcctgaacgcccacaaggacggcgtgtgcgggatccggtccaccacccgcctcgagaacgtgatgtggaagcagatcaccaacgagctgaactacgtcctgtgggagggcgggcacgacctcacggtggtggccggcgacgtcaagggcgtgctgaccaaggggaagcgggcgctgaccccgcccgtgaacgacctcaagtacagctggaagacctggggcaaggccaagatctccacgcccgaggcccgcaacagcaccttcctgatcgacgggcccgacacctccgagtgcccgaacgagcggcgcgcctggaacttcttcgaggtcgaggactacggcttcgggatgttcaccacgaacatctggatgaagttccgggagggcagctccgaggtgtgcgaccaccgcctgatgagcgccgcgatcaaggaccagaaggccgtgcacgccgacatgggctactggatcgagtccagcaagaaccagacctggcagatcgagaaggcctccctcatcgaggtcaagacctgcctgtggcccaagacccacacgctgtggagcaacggggtgctcgagtcccagatgctgatcccccggagctacgcgggcccgttctcccagcacaactaccgccaggggtacgccacccagaccgccggcccctggcacctggggaagctcgagatcgacttcggcgagtgccccggcaccaccgtgaagatccaggaggactgcgaccaccgggggcccagcctgcgcacgaccaccgcctccggcaagctggtcacccagtggtgctgccgcagctgcacgatgccgcccctccggttcctgggggaggacggctgctggtacgggatggagatccgccccctgagcgagaaggaggagaacatggtgaagtcccaggtgaccgccggccagggcaccagcgagaccttctccatggggctcctgtgcctgaccctgttcgtcgaggagtgcctgcggcgccgggtgacccgcaagcacatgatcctggtcgtggtgatcaccttctgcgcgatcatcctcggcgggctgacctggatggacctgctccgggccctgatcatgctgggcgacacgatgagcggccgcatcgggggccagatccacctcgccatcatgaccgtcttcaagatgtcccccgggtacgtgctgggcgtgttcctgcggaagctcaccagccgcgagaccgccctgatggtcatcgggatggccatgacgaccgtgttctccatcccgcacgacctgatggagctcatcgacggcatcagcctgggcctgatcctcctgaagatcgtgacccacttcgacaacacccaggtcgggacgctggcgctctccctgaccttcatgcggagcaccacgcccctggtgatggcctggcgcacgatcatggccgtgttcttcgtcatcaccctcatccccctgtgccggacctcctgcctgcagaagcagagccactgggtggagatcaccgccctcatcctgggcgcccaggcgctgcccgtgtacctcatgacgctgatgaagggggcctcccgccggagctggccgctgaacgagggcatcatggccgtcgggctcgtgtccctgctgggcagcgccctcctgaagaacgacgtgcccctggcgggccccatggtcgccgggggcctcctgctggccgcctacgtgatgtccgggagctccgccgacctcagcctggagaaggcggccaacgtgcagtgggacgagatggccgacatcaccggcagctcccccatcatcgaggtcaagcaggacgaggacgggagcttctccatccgcgacgtggaggagaccaacatgatcaccctgctcgtgaagctggccctgatcacggtcagcggcctctacccgctggccatccccgtgaccatggcgctgtggtacatctggcaggtcaagacccagcggtccggcgccctctgggacgtccccagccccgccgccacccagaaggccacgctgtccgagggggtgtaccgcatcatgcagcggggcctgttcgggaagacccaggtgggcgtcgggatccacatggagggcgtgttccacaccatgtggcacgtgacccgcggcagcgtcatctgccacgagaccgggcggctcgagccgtcctgggcggacgtgcgcaacgacatgatcagctacggcgggggctggcgcctgggcgacaagtgggacaaggaggaggacgtgcaggtcctggccatcgagcccgggaagaacccccggcacgtgcagacgaagcccggcctcttcaagaccctgaccggggagatcggcgccgtgaccctggacttcaagccggggacgtccggcagccccatcatcaacaagaagggcaaggtcatcgggctctacggcaacggggtggtgaccaagtccggcgactacgtcagcgccatcacccaggccgagcgcatcggggagcccgactacgaggtggacgaggacatcttccggaagaagcgcctgaccatcatggacctgcacccgggcgcgggcaagacgaagcggatcctcccctccatcgtgcgcgaggccctgaagcggcgcctgcggaccctcatcctggcccccacccgcgtcgtggccgcggagatggaggaggccctgcgggggctgcccatccgctaccagaccccggccgtgaagtccgagcacacgggccgggagatcgtcgacctcatgtgccacgccaccttcaccacccgcctgctgtccagcacgcgggtgcccaactacaacctcatcgtgatggacgaggcccacttcaccgacccctgctccgtcgcggcccgcgggtacatcagcacccgggtggagatgggcgaggccgccgccatcttcatgaccgcgacgcccccggggagcatcgaccccttcccccagtccaacagccccatcgaggacatcgagcgcgagatcccggagcggtcctggaacaccggcttcgactggatcaccgactaccagggcaagaccgtctggttcgtgcccagcatcaaggccgggaacgacatcgccaactgcctgcgcaagtccggcaagcgcgtgatccagctgagccggaagacgttcgacaccgagtaccccaagaccaagctcaccgactgggacttcgtcgtgacgaccgacatctccgagatgggggccaacttccgcgccggccgggtgatcgacccccgccggtgcctgaagccggtcatcctgaccgacgggcccgagcgcgtgatcctcgcgggccccatccccgtgaccccggccagcgccgcccagcggcgcggccggatcgggcgcaaccccgcgcaggaggacgaccagtacgtcttctccggcgaccccctgaagaacgacgaggaccacgcccactggacggaggccaagatgctgctcgacaacatctacacccccgaggggatcatcccgaccctgttcggccccgagcgggagaagacccaggccatcgacggcgagttccgcctgcgcggggagcagcgcaagacgttcgtggagctcatgcggcgcggcgacctgcccgtgtggctgagctacaaggtcgcctccgcggggatcagctacaaggaccgggagtggtgcttcaccggcgagcgcaacaaccagatcctcgaggagaacatggaggtggagatctggacccgggagggggagaagaagaagctgcgccccaagtggctggacgcccgggtgtacgccgacccgatggccctcaaggacttcaaggagttcgcctccggccgcaagagcaccacgctggacatcctgaccgagatcgcgaccctccccacctacctgtccagcaaggccaagctggccctcgacaacatcgtcatgctgcacaccacggagaagggcgggcgcgcctaccagcacgccctgaacgagctccccgagtccctggagaccctgatgctcgtggcgctgctgggcgccatgaccgccgggatcttcctcttcttcatgcagggcaaggggatcggcaagctgagcatgggcctgatcgccatggcggtggcctccgggctcctgtgggtcgccgagatccagccgcagtggatcgccgccagcatcatcctggagttcttcctcatggtgctgctgatccccgagcccgagaagcagcggacgccccaggacaaccagctcatctacgtgatcctgacgatcctgaccatcatcggcctcatcgcggccaacgagatggggctgatcgagaagaccaagaccgacttcggcttctaccaggtcaagacggagaccaccatcctggacgtggacctccgcccggccagcgcctggaccctgtacgccgtggcgacgaccatcctgacccccatgctccggcacaccatcgagaacacgtccgccaacctgagcctggccgccatcgccaaccaggcggccgtcctcatggggctgggcaagggctggcccctgcaccgcatggacctcggggtgcccctgctggccatgggctgctactcccaggtgaacccgaccaccctcaccgccagcctggtcatgctgctcatccactacgccatcatcgggcccggcctgcaggcgaaggccacgcgggaggcccagaagcgcaccgccgcgggcatcatgaagaaccccaccgtggacgggatcaccgtgatcgacctggagcccatctcctacgacccgaagttcgagaagcagctcggccaggtcatgctgctggtgctctgcgtggggcagctgctgctcatgcggacgacctgggccctgtgcgaggtcctgaccctcgccaccggccccatcatgacgctgtgggaggggaaccccggccgcttctggaacaccaccatcgccgtgagcaccgccaacatcttccggggctcctacctggcgggggccggcctcgccttcagcctgatcaagaacgcccagacgccccgccgggggaccggcaccaccggggagacgctgggcgagaagtggaagcgccagctcaactccctggaccggaaggagttcgaggagtacaagcgcagcggcatcctggaggtggaccggaccgaggccaagtccgcgctccgcgacgggagcaagatcaagcacgccgtctcccggggcagctccaagatccgctggatcgtggagcgggggatgatcaagccgaagggcaaggtggtcgacctggggtgcggccgcggcgggtggagctactacatggccaccctgaagaacgtgaccgaggtgaagggctacaccaagggcggccccgggcacgaggagcccatccccatggccacgtacggctggaacctcgtcaagctgcactccggcgtggacgtgttctacaagccgaccgagcaggtcgacaccctgctctgcgacatcggggagagctccagcaaccccaccatcgaggagggccgcacgctgcggatcctgaagatggtggagccctggctcagctccaagcccgagttctgcatcaaggtgctgaacccgtacatgcccaccgtcatcgaggagctggagaagctccagcgccggcacgggggcagcctggtgcgctgccccctgtcccggaacagcacccacgagatgtactgggtgtccggcgccagcgggaacatcgtctccagcgtgaacaccatctccaagatgctgctcaaccgcttcacgacccggcaccgcaagcccacctacgagaaggacgtcgacctgggcgcggggacccggagcgtgtccacggagaccgagaagccggacatgaccatcatcggccgccggctgcagcgcctccaggaggagcacaaggagacctggcactacgaccaggagaacccctaccggacgtgggcctaccacgggagctacgaggccccctccaccggcagcgcctccagcatggtgaacggcgtcgtgaagctgctgaccaagccgtgggacgtgatccccatggtcacccagctcgcgatgacggacaccacccccttcgggcagcagcgcgtgttcaaggagaaggtggacacccggacgccccagccgaagctgggcacccgcatgatcatgaccaccacggccaactggctgtgggccctcctggggaagaagaagtccccgcggctgtgcacccgcgaggagttcatcagcaaggtccggagcaacgccgccatcggcgcggtgttccaggaggagcaggggtggaccagcgccagcgaggccgtgaacgactcccgcttctgggagctcgtcgacaaggagcgggccctgcaccaggagggcaagtgcgagagctgcgtgtacaacatgatgggcaagcgcgagaagaagctgggggagttcggccgcgccaaggggtcccgggcgatctggtacatgtggctcggcgcccgcttcctggagttcgaggccctggggttcctcaacgaggaccactggttcagccgggagaactcctggagcggcgtggagggcgaggggctgcaccgcctgggctacatcctcgaggacatcgacaagaaggacggggacctgatctacgccgacgacaccgccggctgggacacgcggatcaccgaggacgacctgctcaacgaggagctgatcaccgagcagatggcgccccaccacaagaccctggccaaggccatcttcaagctcacgtaccagaacaaggtcgtgaaggtgctgcgccccacccccaagggcgccgtcatggacatcatctcccggaaggaccagcgcgggagcggccaggtggggacctacggcctgaacaccttcaccaacatggaggtgcagctcatccggcagatggaggcggagggggtcatcacgcaggacgacatgcagaaccccaagggcctgaaggagcgcgtggagaagtggctgaaggagtgcggcgtggaccggctcaagcgcatggccatctccggggacgactgcgtcgtgaagcccctggacgagcggttcagcacctccctcctcttcctgaacgacatgggcaaggtgcgcaaggacgtcccccagtgggagccgagcaaggggtggaagaactggcaggaggtgcccttctgctcccaccacttccacaagatcttcatgaaggacggccggagcctggtggtcccctgccgcaaccaggacgagctcatcgggcgggcccgcatctcccagggcgccggctggagcctgcgggagaccgcctgcctggggaaggcgtacgcccagatgtggtccctcatgtacttccaccgccgcgacctgcggctggccagcatggccatctgcagcgccgtgcccaccgagtggttcccgacgtcccgcaccacctggagcatccacgcgcagcaccagtggatgaccacggaggacatgctcaaggtgtggaaccgggtctggatcgaggacaaccccaacatgaccgacaagacccccgtgcactcctgggaggacatcccctacctgggcaagcgcgaggacctgtggtgcgggagcctcatcggcctgtccagccgggccacctgggccaagaacatccacacggccatcacccaggtgcgcaacctgatcgggaaggaggagtacgtcgactacatgccggtgatgaagcggtactccagcccctccgagagcgagggcgtgctctga

SEQ ID NO: 10495 - RNA, 9867 nt, synthetic construct
  misc_feature 1..9867: note = derived and/or modified CDS sequence (opt1) from DENV-4__JQ915086__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaagatccccatcgagatccgggacgtcaacaaggagaaggtggtgggccgcatcatcagctccacccccttcgcggagaacacgaacagcgtcatcaacatcgagctggagccgcccttcggggactcctacatcgtgatcggcgtgggcgacagcgccctcaccctgcactggttccggaaggggtccagcatcggcaagatgttcgagtccacctaccgcggggccaagcggatggccatcctgggcgagaccgcgtgggacttcgggagcgtcggcggcctcttcacgtccctggggaaggccgtgcaccaggtgttcggcagcgtctacaccaccatgttcgggggcgtgtcctggatgatccgcatcctgatcgggttcctcgtgctgtggatcggcaccaacagccggaacacgtccatggccatgacctgcatcgccgtcggcgggatcaccctgttcctgggcttcaccgtgcaggccgacatggggtgcgtggtcagctggaacggcaaggagctcaagtgcgggtccggcatcttcgtggtggacaacgtccacacgtggaccgagcagtacaagttccagcccgagagccccgcgcgcctggccagcgccatcctgaacgcccacaaggacggcgtgtgcgggatccggtccaccacccgcctcgagaacgtgatgtggaagcagatcacgaacgagctgaactacgtcctgtgggagggcgggcacgacctcaccgtggtggccggcgacgtcaagggcgtgctgaccaaggggaagcgggtgctgaccccgcccgtcaacgacctcaagtacagctggaagacgtggggcaaggcgaagatcttcacccccgaggcccgcaactccaccttcctgatcgacgggcccgacaccagcgagtgcccgaacgagcggcgcgcctggaacttcttcgaggtggaggactacggcttcgggatgttcacgaccaacatctggatgaagttccgggagggctccagcgaggtgtgcgaccaccgcctgatgtccgccgccatcaaggaccagaaggcggtccacgccgacatgggctactggatcgagagctccaagaaccagacctggcagatcgagaaggccagcctcatcgaggtgaagacctgcctgtggcccaagacgcacaccctgtggtccaacggggtgctcgagagccagatgctgatcccccggtcctacgccggcccgttcagccagcacaactaccgccaggggtacgcgacccagaccgccggcccctggcacctggggaagctcgagatcgacttcggcgagtgccccggcaccacggtcaagatccaggaggactgcgaccaccgggggccctccctgcgcaccaccaccgccagcggcaagctggtgacgcagtggtgctgccgctcctgcaccatgccgcccctccggttcctgggggaggacggctgctggtacgggatggagatccgccccctgagcgagaaggaggagaacatggtcaagagccaggtcaccgccggccagggcacctccgagacgttcagcatggggctcctgtgcctgaccctcttcgtggaggagtgcctgcggcgccgggtcacccgcaagcacatgatcctggtggtggtcatcaccttctgcgccatcatcctcggcgggctgacgtggatggacctgctccgggcgctgatcatgctgggcgacaccatgtccggccgcatcgggggccagatccacctcgccatcatgaccgtgttcaagatgagccccgggtacgtgctgggcgtcttcctgcggaagctcacctcccgcgagacggccctgatggtgatcgggatggccatgaccaccgtgttcagcatcccgcacgacctgatggagctcatcgacggcatctccctgggcctgatcctcctgaagatcgtcacccacttcgacaacacccaggtggggaccctggccctcagcctgaccttcatccggtccaccacgcccctggtgatggcgtggcgcaccatcatggccgtcttcttcgtgatcaccctcatccccctgtgccggaccagctgcctgcagaagcagtcccactgggtggagatcacggccctcatcctgggcgcccaggccctgcccgtctacctcatgaccctgatgaagggggcgagccgccggtcctggccgctgaacgagggcatcatggccgtggggctcgtgagcctgctgggctccgccctcctgaagaacgacgtccccctggccggccccatggtggccgggggcctcctgctggccgcctacgtgatgagcgggtccagcgccgacctctccctggagaaggccgcgaacgtccagtgggacgagatggccgacatcaccggcagcagccccatcatcgaggtgaagcaggacgaggacgggtccttcagcatccgcgacgtggaggagaccaacatgatcacgctgctcgtcaagctggccctgatcaccgtgtccggcctctacccgctggccatccccgtgaccatggccctgtggtacatctggcaggtcaagacccagcggagcggcgcgctctgggacgtgccctcccccgccgccacgcagaaggccaccctgagcgagggggtgtaccgcatcatgcagcggggcctgttcgggaagacccaggtcggcgtggggatccacatggagggcgtgttccacaccatgtggcacgtcacccgcggctccgtgatctgccacgagacggggcggctcgagccgagctgggccgacgtgcgcaacgacatgatctcctacggcgggggctggcgcctgggcgacaagtgggacaaggaggaggacgtccaggtgctggcgatcgagcccgggaagaacccccggcacgtgcagaccaagcccggcctcttcaagaccctgaccggggagatcggcgccgtcacgctggacttcaagccggggaccagcggctcccccatcatcaacaagaagggcaaggtgatcgggctctacggcaacggggtggtcaccaagagcggcgactacgtgtccgccatcacccaggccgagcgcatcggggagcccgactacgaggtggacgaggacatcttccggaagaagcgcctgacgatcatggacctgcacccgggcgccggcaagaccaagcggatcctccccagcatcgtccgcgaggcgctgaagcggcgcctgcggaccctcatcctggcccccacccgcgtggtggccgccgagatggaggaggcgctgcgggggctgcccatccgctaccagacgccggccgtcaagtccgagcacaccggccgggagatcgtggacctcatgtgccacgccaccttcaccacgcgcctgctgagctccacccgggtgcccaactacaacctcatcgtcatggacgaggcccacttcaccgacccctgcagcgtggccgcgcgcgggtacatctccacccgggtcgagatgggcgaggccgccgccatcttcatgacggccacgcccccggggagcatcgaccccttcccccagagcaactcccccatcgaggacatcgagcgcgagatcccggagcggagctggaacaccggcttcgactggatcaccgactaccagggcaagacggtgtggttcgtgccctccatcaaggcggggaacgacatcgccaactgcctgcgcaagagcggcaagcgcgtcatccagctgtcccggaagaccttcgacaccgagtaccccaagaccaagctcacggactgggacttcgtggtgaccaccgacatcagcgagatgggggccaacttccgcgccggccgggtcatcgacccccgccggtgcctgaagccggtgatcctgaccgacgggcccgagcgcgtgatcctcgccggccccatccccgtcacgccggcgtccgccgcccagcggcgcggccggatcgggcgcaaccccgcccaggaggacgaccagtacgtgttcagcggcgaccccctgaagaacgacgaggaccacgcgcactggaccgaggccaagatgctgctcgacaacatctacacccccgaggggatcatcccgaccctgttcggccccgagcgggagaagacgcaggccatcgacggcgagttccgcctgcgcggggagcagcgcaagaccttcgtggagctcatgcggcgcggcgacctgcccgtctggctgtcctacaaggtggccagcgccgggatctcctacaaggaccgggagtggtgcttcaccggcgagcgcaacaaccagatcctcgaggagaacatggaggtggagatctggacccgggagggggagaagaagaagctgcgccccaagtggctggacgcgcgggtctacgccgacccgatggccctcaaggacttcaaggagttcgccagcggccgcaagtccacgaccctggacatcctgaccgagatcgccaccctccccacctacctgagctccaaggcgaagctggccctcgacaacatcgtgatgctgcacacgaccgagaagggcgggcgcgcctaccagcacgccctgaacgagctccccgagagcctggagaccctgatgctcgtggccctgctgggcgcgatgaccgccgggatcttcctcttcttcatgcagggcaaggggatcggcaagctgtccatgggcctgatcgccatcgccgtcgcgagcgggctcctgtgggtggccgagatccagccgcagtggatcgccgcctccatcatcctggagttcttcctcatggtgctgctgatccccgagcccgagaagcagcggacgccccaggacaaccagctcatctacgtcatcctgaccatcctgaccatcatcggcctcatcgccgcgaacgagatggggctgatcgagaagaccaagacggacttcggcttctaccaggtgaagaccgagaccaccatcctggacgtggacctccgcccggccagcgcctggacgctgtacgccgtcgccaccaccatcctgacccccatgctccggcacacgatcgagaacaccagcgcgaacctgtccctggccgccatcgccaaccaggccgcggtgctcatggggctgggcaagggctggcccctgcaccgcatggacctcggggtgcccctgctggccatgggctgctacagccaggtcaacccgaccaccctcacggcctccctggtgatgctgctcatccactacgccatcatcgggcccggcctgcaggccaaggcgacccgggaggcccagaagcgcaccgccgccggcatcatgaagaaccccaccgtggacgggatcacggtcatcgacctggagcccatcagctacgacccgaagttcgagaagcagctcggccaggtgatgctgctggtgctctgcgtcgggcagctgctgctcatgcggaccacctgggcgctgtgcgaggtgctgaccctcgccacgggccccatcatgaccctgtgggaggggaaccccggccgcttctggaacaccaccatcgccgtgtccacggccaacatcttccggggcagctacctggccggggcgggcctcgccttctccctgatcaagaacgcccagacgccccggcgggggaccggcaccacgggggagaccctgggcgagaagtggaagcgccagctcaacagcctggaccggaaggagttcgaggagtacaagcgctccggcatcctggaggtcgaccggaccgaggccaagagcgccctccgcgacgggtccaagatcaagcacgcggtgagccggggctccagcaagatccgctggatcgtggagcgggggatgatcaagccgaagggcaaggtcgtggacctggggtgcggccgcggcgggtggtcctactacatggccaccctgaagaacgtgaccgaggtcaagggctacacgaagggcggccccgggcacgaggagcccatccccatggccacctacggctggaacctcgtgaagctgcacagcggcgtggacgtcttctacaagccgaccgagcaggtcgacaccctgctctgcgacatcggggagtccagctccaaccccacgatcgaggagggccgcaccctgcggatcctgaagatggtggagccctggctcagcagcaagcccgagttctgcatcaaggtcctgaacccgtacatgcccaccgtgatcgaggagctggagaagctccagcgccggcacgggggctccctggtgcgctgccccctgagccggaactccacccacgagatgtactgggtcagcggcgcctccgggaacatcgtgagctccgtcaacacgatcagcaagatgctgctcaaccgcttcaccacccggcaccgcaagcccacctacgagaaggacgtggacctgggcgccgggacgcggtccgtgagcaccgagaccgagaagccggacatgaccatcatcggccgccggctgcagcgcctccaggaggagcacaaggagacgtggcactacgaccaggagaacccctaccggacctgggcgtaccacgggtcctacgaggcccccagcaccggctccgccagctccatggtcaacggcgtggtgaagctgctgaccaagccgtgggacgtcatccccatggtgacgcagctcgccatgaccgacaccacccccttcgggcagcagcgcgtgttcaaggagaaggtcgacacgcggacgccccagccgaagctgggcacccgcatgatcatgaccacgaccgcgaactggctgtgggccctcctggggaagaagaagtccccgcggctgtgcacccgcgaggagttcatctccaaggtgcggagcaacgccgccatcggcgccgtgttccaggaggagcaggggtggacctccgcgagcgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttctcccgggagaacagctggtccggcgtcgagggcgaggggctgcaccgcctgggctacatcctcgaggacatcgacaagaaggacggggacctgatctacgccgacgacacggccggctgggacacccggatcaccgaggacgacctgctcaacgaggagctgatcaccgagcagatggcgccccaccacaagacgctggcgaaggccatcttcaagctcacctaccagaacaaggtggtgaaggtcctgcgccccacccccaagggcgccgtgatggacatcatcagccggaaggaccagcgcgggtccggccaggtggggacctacggcctgaacaccttcacgaacatggaggtccagctcatccggcagatggaggccgagggggtgatcacccaggacgacatgcagaaccccaagggcctgaaggagcgcgtggagaagtggctgaaggagtgcggcgtcgaccggctcaagcgcatggcgatcagcggggacgactgcgtggtgaagcccctggacgagcggttctccaccagcctcctgttcctgaacgacatgggcaaggtccgcaaggacgtgccccagtgggagccgtccaaggggtggaagaactggcaggaggtgcccttctgcagccaccacttccacaagatcttcatgaaggacggccggtccctggtcgtgccctgccgcaaccaggacgagctcatcgggcgggcccgcatcagccagggcgccggctggtccctgcgggagaccgcctgcctggggaaggcctacgcgcagatgtggagcctcatgtacttccaccgccgcgacctgcggctggcctccatggccatctgcagcgccgtgcccacggagtggttcccgaccagccgcaccacctggtccatccacgcccagcaccagtggatgacgaccgaggacatgctcaaggtctggaaccgggtgtggatcgaggacaaccccaacatgaccgacaagacccccgtgcacagctgggaggacatcccctacctgggcaagcgcgaggacctgtggtgcgggtccctcatcggcctgagctcccgggcgacgtgggccaagaacatccacaccgccatcacccaggtccgcaacctgatcgggaaggaggagtacgtggactacatgccggtgatgaagcggtacagcgccccctccgagagcgagggcgtcctctga

SEQ ID NO: 10496 - RNA, 9867 nt, synthetic construct
  misc_feature 1..9867: note = derived and/or modified CDS sequence (opt1) from DENV-4__JQ915087__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcatcgtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcacgaccatggcccagggcaagcccaccctggacttcgagctcaccaagacgaccgccaaggaggtggccctgctgcggacctactgcatcgaggcctccatcagcaacatcaccacggcgacccgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcctgtgctccggcaagatcacggggaacctcgtccagatcgagaacctggagtacaccgtggtggtcaccgtgcacaacggcgacacccacgccgtcggcaacgacacgagcaaccacggggtgaccgccaccatcacgccccggtcccccagcgtggaggtcaagctgccggactacggcgagctcacgctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcaccttcaaggtgccgcacgccaagcggcaggacgtgacggtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacccagcacgggacgaccgtcgtgaaggtgaagtacgagggcgccggggccccctgcaagatccccatcgagatccgggacgtcaacaaggagaaggtggtgggccgcatcatcagctccacccccttcgcggagaacaccaacagcgtcatcaacatcgagctggagccgcccttcggggactcctacatcgtgatcggcgtgggcgacagcgccctcacgctgcactggttccggaaggggtccagcatcggcaagatgttcgagtccacctaccgcggggccaagcggatggccatcctgggcgagaccgcgtgggacttcgggagcgtcggcggcctcttcacctccctggggaaggccgtgcaccaggtgttcggcagcgtctacacgaccatgttcgggggcgtgtcctggatgatccgcatcctgatcgggttcctcgtgctgtggatcggcaccaacagccggaacacctccatggccatgacgtgcatcgccgtcggcgggatcaccctgttcctgggcttcaccgtgcaggccgacatggggtgcgtggtcagctggaacggcaaggagctcaagtgcgggtccggcatcttcgtggtggacaacgtccacacctggacggagcagtacaagttccagcccgagagccccgcgcgcctggccagcgccatcctgaacgcccacaaggacggcgtgtgcgggatccggtccaccacccgcctcgagaacgtgatgtggaagcagatcaccaacgagctgaactacgtcctgtgggagggcgggcacgacctcacggtggtggccggcgacgtcaagggcgtgctgaccaaggggaagcgggcgctgaccccgcccgtgaacgacctcaagtacagctggaagacctggggcaaggccaagatcttcacgcccgaggcccgcaactccaccttcctgatcgacgggcccgacaccagcgagtgcccgaacgagcggcgcgcctggaacttcttcgaggtcgaggactacggcttcgggatgttcaccacgaacatctggatgaagttccgggagggctccagcgaggtgtgcgaccaccgcctgatgtccgccgcgatcaaggaccagaaggccgtgcacgccgacatgggctactggatcgagagctccaagaaccagacctggcagatcgagaaggccagcctcatcgaggtcaagacctgcctgtggcccaagacccacacgctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcaccaccgtgaagatccaggaggactgcgaccaccgggggccctccctgcgcacgaccaccgccagcggcaagctggtcacccagtggtgctgccgctcctgcacgatgccgcccctccggttcctgggggaggacggctgctggtacgggatggagatccgccccctgagcgagaaggaggagaacatggtcaagagccaggtgaccgccggccagggcacctccgagaccttcagcatggggctcctgtgcctgaccctcttcgtcgaggagtgcctgcggcgccgggtgacccgcaagcacatgatcctggtcgtggtgatcaccttctgcgcgatcatcctcggcgggctgacctggatggacctgctccgggccctgatcatgctgggcgacacgatgtccggccgcatcgggggccagatccacctcgccatcatgaccgtcttcaagatgagccccgggtacgtgctgggcgtgttcctgcggaagctcacctcccgcgagaccgccctgatggtcatcgggatggccatgacgaccgtgttcagcatcccgcacgacctgatggagctcatcgacggcatctccctgggcctgatcctcctgaagatcgtgacccacttcgacaacacccaggtcgggacgctggcgctcagcctgaccttcatccggtccaccacgcccctggtgatggcctggcgcacgatcatggccgtgttcttcgtcatcaccctcatccccctgtgccggaccagctgcctgcagaagcagtcccactgggtggagatcaccgccctcatcctgggcgcccaggcgctgcccgtgtacctcatgacgctgatgaagggggccagccgccggtcctggccgctgaacgagggcatcatggccgtcgggctcgtgagcctgctgggctccgccctcctgaagaacgacgtgcccctggcgggccccatggtcgccgggggcctcctgctggccgcctacgtgatgagcgggtccagcgccgacctctccctggagaaggcggccaacgtgcagtgggacgagatggccgacatcaccggcagcagccccatcatcgaggtcaagcaggacgaggacgggtccttcagcatccgcgacgtggaggagaccaacatgatcaccctgctcgtgaagctggccctgatcacggtctccggcctctacccgctggccatccccgtgaccatggcgctgtggtacatctggcaggtcaagacccagcggagcggcgccctctgggacgtcccctcccccgccgccacccagaaggccacgctgagcgagggggtgtaccgcatcatgcagcggggcctgttcgggaagacccaggtgggcgtcgggatccacatggagggcgtgttccacaccatgtggcacgtgacccgcggctccgtcatctgccacgagaccgggcggctcgagccgagctgggcggacgtgcgcaacgacatgatctcctacggcgggggctggcgcctgggcgacaagtgggacaaggaggaggacgtgcaggtcctggccatcgagcccgggaagaacccccggcacgtgcagacgaagcccggcctcttcaagaccctgaccggggagatcggcgccgtgaccctggacttcaagccggggacgagcggctcccccatcatcaacaagaagggcaaggtcatcgggctctacggcaacggggtggtgaccaagagcggcgactacgtctccgccatcacccaggccgagcgcatcggggagcccgactacgaggtggacgaggacatcttccggaagaagcgcctgaccatcatggacctgcacccgggcgcgggcaagacgaagcggatcctccccagcatcgtgcgcgaggccctgaagcggcgcctgcggaccctcatcctggcccccacccgcgtcgtggccgcggagatggaggaggccctgcgggggctgcccatccgctaccagaccccggccgtgaagtccgagcacacgggccgggagatcgtcgacctcatgtgccacgccaccttcaccacccgcctgctgagctccacgcgggtgcccaactacaacctcatcgtgatggacgaggcccacttcaccgacccctgcagcgtcgcggcccgcgggtacatctccacccgggtggagatgggcgaggccgccgccatcttcatgaccgcgacgcccccggggagcatcgaccccttcccccagagcaactcccccatcgaggacatcgagcgcgagatcccggagcggagctggaacaccggcttcgactggatcaccgactaccagggcaagaccgtctggttcgtgccctccatcaaggccgggaacgacatcgccaactgcctgcgcaagagcggcaagcgcgtgatccagctgtcccggaagacgttcgacaccgagtaccccaagaccaagctcaccgactgggacttcgtcgtgacgaccgacatcagcgagatgggggccaacttccgcgccggccgggtgatcgacccccgccggtgcctgaagccggtcatcctgaccgacgggcccgagcgcgtgatcctcgcgggccccatccccgtgaccccggcctccgccgcccagcggcgcggccggatcgggcgcaaccccgcgcaggaggacgaccagtacgtcttcagcggcgaccccctgaagaacgacgaggaccacgcccactggacggaggccaagatgctgctcgacaacatctacacccccgaggggatcatcccgaccctgttcggccccgagcgggagaagacccaggccatcgacggcgagttccgcctgcgcggggagcagcgcaagacgttcgtggagctcatgcggcgcggcgacctgcccgtgtggctgtcctacaaggtcgccagcgcggggatctcctacaaggaccgggagtggtgcttcaccggcgagcgcaacaaccagatcctcgaggagaacatggaggtggagatctggacccgggagggggagaagaagaagctgcgccccaagtggctggacgcccgggtgtacgccgacccgatggccctcaaggacttcaaggagttcgccagcggccgcaagtccaccacgctggacatcctgaccgagatcgcgaccctccccacctacctgagctccaaggccaagctggccctcgacaacatcgtcatgctgcacaccacggagaagggcgggcgcgcctaccagcacgccctgaacgagctccccgagagcctggagaccctgatgctcgtggcgctgctgggcgccatgaccgccgggatcttcctcttcttcatgcagggcaaggggatcggcaagctgtccatgggcctgatcgccatcgcggtggccagcgggctcctgtgggtcgccgagatccagccgcagtggatcgccgcctccatcatcctggagttcttcctcatggtgctgctgatccccgagcccgagaagcagcggacgccccaggacaaccagctcatctacgtgatcctgacgatcctgaccatcatcggcctcatcgcggccaacgagatggggctgatcgagaagaccaagaccgacttcggcttctaccaggtcaagacggagaccaccatcctggacgtggacctccgcccggccagcgcctggaccctgtacgccgtggcgacgaccatcctgacccccatgctccggcacaccatcgagaacacgagcgccaacctgtccctggccgccatcgccaaccaggcggccgtcctcatggggctgggcaagggctggcccctgcaccgcatggacctcggggtgcccctgctggccatgggctgctacagccaggtgaacccgaccaccctcaccgcctccctggtcatgctgctcatccactacgccatcatcgggcccggcctgcaggcgaaggccacgcgggaggcccagaagcgcaccgccgcgggcatcatgaagaaccccaccgtggacgggatcaccgtgatcgacctggagcccatcagctacgacccgaagttcgagaagcagctcggccaggtcatgctgctggtgctctgcgtggggcagctgctgctcatgcggacgacctgggccctgtgcgaggtcctgaccctcgccaccggccccatcatgacgctgtgggaggggaaccccggccgcttctggaacaccaccatcgccgtgtccaccgccaacatcttccggggcagctacctggcgggggccggcctcgccttctccctgatcaagaacgcccagacgccccgccgggggaccggcaccaccggggagacgctgggcgagaagtggaagcgccagctcaacagcctggaccggaaggagttcgaggagtacaagcgctccggcatcctggaggtggaccggaccgaggccaagagcgcgctccgcgacgggtccaagatcaagcacgccgtcagccggggctccagcaagatccgctggatcgtggagcgggggatgatcaagccgaagggcaaggtggtcgacctggggtgcggccgcggcgggtggtcctactacatggccaccctgaagaacgtgaccgaggtgaagggctacaccaagggcggccccgggcacgaggagcccatccccatggccacgtacggctggaacctcgtcaagctgcacagcggcgtggacgtgttctacaagccgaccgagcaggtcgacaccctgctctgcgacatcggggagtccagctccaaccccaccatcgaggagggccgcacgctgcggatcctgaagatggtggagccctggctcagcagcaagcccgagttctgcatcaaggtgctgaacccgtacatgcccaccgtcatcgaggagctggagaagctccagcgccggcacgggggctccctggtgcgctgccccctgagccggaactccacccacgagatgtactgggtgagcggcgcctccgggaacatcgtcagctccgtgaacaccatcagcaagatgctgctcaaccgcttcacgacccggcaccgcaagcccacctacgagaaggacgtcgacctgggcgcggggacccggtccgtgagcacggagaccgagaagccggacatgaccatcatcggccgccggctgcagcgcctccaggaggagcacaaggagacctggcactacgaccaggagaacccctaccggacgtgggcctaccacgggtcctacgaggcccccagcaccggctccgccagctccatggtgaacggcgtcgtgaagctgctgaccaagccgtgggacgtgatccccatggtcacccagctcgcgatgacggacaccacccccttcgggcagcagcgcgtgttcaaggagaaggtggacacccggacgccccagccgaagctgggcacccgcatgatcatgaccaccacggccaactggctgtgggccctcctggggaagaagaagtccccgcggctgtgcacccgcgaggagttcatctccaaggtccggagcaacgccgccatcggcgcggtgttccaggaggagcaggggtggacctccgccagcgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggcgatctggtacatgtggctcggcgcccgcttcctggagttcgaggccctggggttcctcaacgaggaccactggttctcccgggagaacagctggtccggcgtggagggcgaggggctgcacagcctgggctacatcctcgaggacatcgacaagaaggacggggacctgatctacgccgacgacaccgccggctgggacacgcgcatcaccgaggacgacctgctcaacgaggagctgatcaccgagcagatggcgccccaccacaagaccctggccaaggccatcttcaagctcacgtaccagaacaaggtcgtgaaggtgctgcggcccacccccaagggcgccgtcatggacatcatctcccgcaaggaccagcgggggagcggccaggtggggacctacggcctgaacaccttcaccaacatggaggtgcagctcatccgccagatggaggcggagggggtcatcacgcaggacgacatgcagaaccccaagggcctgaaggagcgggtggagaagtggctgaaggagtgcggcgtggaccgcctcaagcggatggccatctccggggacgactgcgtcgtgaagcccctggacgagcgcttcagcacctccctcctgttcctgaacgacatgggcaaggtgcggaaggacgtcccccagtgggagccgagcaaggggtggaagaactggcaggaggtgcccttctgctcccaccacttccacaagatcttcatgaaggacggccgcagcctggtggtcccctgccggaaccaggacgagctcatcgggcgcgcccggatctcccagggcgccggctggagcctgcgcgagaccgcctgcctggggaaggcgtacgcccagatgtggtccctcatgtacttccaccggcgcgacctgcgcctggccagcatggccatctgcagcgccgtgcccaccgagtggttcccgacgtcccggaccacctggagcatccacgcgcagcaccagtggatgaccacggaggacatgctcaaggtgtggaaccgcgtctggatcgaggacaaccccaacatgaccgacaagacccccgtgcactcctgggaggacatcccctacctgggcaagcgggaggacctgtggtgcgggagcctcatcggcctgtccagccgcgccacctgggccaagaacatccacacggccatcacccaggtgcggaacctgatcgggaaggaggagtacgtcgactacatgccggtgatgaagcgctactccgcccccagcgagtccgagggcgtgctctga

SEQ ID NO: 10497 - RNA, 9867 nt, synthetic construct
  misc_feature 1..9867: note = derived and/or modified CDS sequence (opt1) from DENV-4__JQ915089__SS-prME
  source 1..9867: mol_type = other RNA
agcaccatgaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaagatccccatcgagatccgggacgtcaacaaggagaaggtggtgggccgcatcatcagctccacccccttcgcggagaacacgaacagcgtcatcaacatcgagctggagccgcccttcggggactcctacatcgtgatcggcgtgggcgacagcgccctcaccctgcactggttccggaaggggtccagcatcggcaagatgttcgagtccacctaccgcggggccaagcggatggccatcctgggcgagaccgcgtgggacttcgggagcgtcggcggcctcttcacgtccctggggaaggccgtgcaccaggtgttcggcagcgtctacaccaccatgttcgggggcgtgtcctggatgatccgcatcctgatcgggttcctcgtgctgtggatcggcaccaacagccggaacacgtccatggccatgacctgcatcgccgtcggcgggatcaccctgttcctgggcttcaccgtgcaggccgacatggggtgcgtggtcagctggaacggcaaggagctcaagtgcgggtccggcatcttcgtggtggacaacgtccacacgtggaccgagcagtacaagttccagcccgagagccccgcgcgcctggccagcgccatcctgaacgcccacaaggacggcgtgtgcgggatccggtccaccacccgcctcgagaacgtgatgtggaagcagatcacgaacgagctgaactacgtcctgtgggagggcgggcacgacctcaccgtggtggccggcgacgtcaagggcgtgctgaccaaggggaagcgggtgctgaccccgcccgtcaacgacctcaagtacagctggaagacgtggggcaaggcgaagatcttcacccccgaggcccgcaactccaccttcctgatcgacgggcccgacaccagcgagtgcccgaacgagcggcgcgcctggaacttcttcgaggtggaggactacggcttcgggatgttcacgaccaacatctggatgaagttccgggagggctccagcgaggtgtgcgaccaccgcctgatgtccgccgccatcaaggaccagaaggcggtccacgccgacatgggctactggatcgagagctccaagaaccagacctggcagatcgagaaggccagcctcatcgaggtgaagacctgcctgtggcccaagacgcacaccctgtggtccaacggggtgctcgagagccagatgctgatcccccggtcctacgccggcccgttcagccagcacaactaccgccaggggtacgcgacccagaccgccggcccctggcacctggggaagctcgagatcgacttcggcgagtgccccggcaccacggtcaagatccaggaggactgcgaccaccgggggccctccctgcgcaccaccaccgccagcggcaagctggtgacgcagtggtgctgccgctcctgcaccatgccgcccctccggttcctgggggaggacggctgctggtacgggatggagatccgccccctgagcgagaaggaggagaacatggtgaagtcccaggtcaccgccggccagggcacctccgagacgttcagcatggggctcctgtgcctgaccctcttcgtggaggagtgcctgcggcgccgggtcacccgcaagcacatgatcctggtggtggtcatcaccttctgcgccatcatcctcggcgggctgacgtggatggacctgctccgggcgctgatcatgctgggcgacaccatgtccggccgcatcgggggccagatccacctcgccatcatgaccgtgttcaagatgagccccgggtacgtgctgggcgtcttcctgcggaagctcacctcccgcgagacggccctgatggtgatcgggatggccatgaccaccgtgttcagcatcccgcacgacctgatggagctcatcgacggcatctccctgggcctgatcctcctgaagatcgtcacccacttcgacaacacccaggtggggaccctggccctcagcctgaccttcatccggtccaccacgcccctggtgatggcgtggcgcaccatcatggccgtcttcttcgtgatcaccctcatccccctgtgccggaccagctgcctgcagaagcagtcccactgggtggagatcacggccctcatcctgggcgcccaggccctgcccgtctacctcatgaccctgatgaagggggcgagctcccgcagctggccgctgaacgagggcatcatggccgtggggctcgtgtccctgctgggcagcgccctcctgaagaacgacgtccccctggccggccccatggtggccgggggcctcctgctggccgcctacgtgatgtccgggagctccgccgacctcagcctggagaaggccgcgaacgtccagtgggacgagatggccgacatcaccggcagctcccccatcatcgaggtgaagcaggacgaggacgggagcttctccatccgggacgtggaggagaccaacatgatcacgctgctcgtcaagctggccctgatcaccgtgagcggcctctacccgctggccatccccgtgaccatggccctgtggtacatctggcaggtcaagacccagcgctccggcgcgctctgggacgtgcccagccccgccgccacgcagaaggccaccctgtccgagggggtgtaccggatcatgcagcgcggcctgttcgggaagacccaggtcggcgtggggatccacatggagggcgtgttccacaccatgtggcacgtcacccggggcagcgtgatctgccacgagacggggcgcctcgagccgtcctgggccgacgtgcggaacgacatgatcagctacggcgggggctggcgcctgggcgacaagtgggacaaggaggaggacgtccaggtgctggcgatcgagcccgggaagaacccccgccacgtgcagaccaagcccggcctcttcaagaccctgaccggggagatcggcgccgtcacgctggacttcaagccggggacctccggcagccccatcatcaacaagaagggcaaggtgatcgggctctacggcaacggggtggtcaccaagtccggcgactacgtgagcgccatcacccaggccgagcggatcggggagcccgactacgagatcgacgaggacatcttccgcaagaagcggctgacgatcatggacctgcacccgggcgccggcaagaccaagcgcatcctcccctccatcgtgcgggaggcgctgaagcgccggctgcgcaccctcatcctggcccccacccgggtcgtggccgccgagatggaggaggcgctgcgcgggctgcccatccggtaccagacgccggccgtcaagagcgagcacaccggccgcgagatcgtcgacctcatgtgccacgccaccttcaccacgcggctgctgtccagcacccgcgtgcccaactacaacctcatcgtgatggacgaggcccacttcaccgacccctgctccgtcgccgcgcgggggtacatcagcacccgcgtggagatgggcgaggccgccgccatcttcatgacggccacgcccccggggagcatcgaccccttcccccagtccaacagccccatcgaggacatcgagcgggagatcccggagcgctcctggaacaccggcttcgactggatcaccgactaccagggcaagacggtctggttcgtgcccagcatcaaggcggggaacgacatcgccaactgcctgcggaagtccggcaagcgcgtgatccagctgagccgcaagaccttcgacaccgagtaccccaagaccaagctcacggactgggacttcgtcgtgaccaccgacatctccgagatgggggccaacttccgggccggccgcgtgatcgacccccggcgctgcctgaagccggtcatcctgaccgacgggcccgagcgggtgatcctcgccggccccatccccgtgacgccggcgagcgccgcccagcgccggggccgcatcgggcggaaccccgcccaggaggacgaccagtacgtcttctccggcgaccccctgaagaacgacgaggaccacgcgcactggaccgaggccaagatgctgctcgacaacatctacacccccgaggggatcatcccgaccctgttcggccccgagcgcgagaagacgcaggccatcgacggcgagttccggctgcgcggggagcagcggaagaccttcgtggagctcatgcgccggggcgacctgcccgtgtggctgagctacaaggtcgcctccgccgggatcagctacaaggaccgcgagtggtgcttcaccggcgagcggaacaaccagatcctcgaggagaacatggaggtggagatctggacccgcgagggggagaagaagaagctgcggcccaagtggctggacgcgcgcgtgtacgccgacccgatggccctcaaggacttcaaggagttcgcctccggccgcaagagcacgaccctggacatcctgaccgagatcgccaccctccccacctacctgtccagcaaggcgaagctggccctcgacaacatcgtcatgctgcacacgaccgagaagggcgggcgcgcctaccagcacgccctgaacgagctccccgagtccctggagaccctgatgctcgtggccctgctgggcgcgatgaccgccgggatcttcctcttcttcatgcagggcaaggggatcggcaagctgagcatgggcctgatcgccatcgccgtggcgtccgggctcctgtgggtcgccgagatccagccgcagtggatcgccgccagcatcatcctggagttcttcctcatggtgctgctgatccccgagcccgagaagcagcgcacgccccaggacaaccagctcatctacgtgatcctgaccatcctgaccatcatcggcctcatcgccgcgaacgagatggggctgatcgagaagaccaagacggacttcggcttctaccaggtcaagaccgagaccaccatcctggacgtggacctccggccggccagcgcctggacgctgtacgccgtggccaccaccatcctgacccccatgctccgccacacgatcgagaacacctccgcgaacctgagcctggccgccatcgccaaccaggccgcggtcctcatggggctgggcaagggctggcccctgcaccggatggacctcggggtgcccctgctggccatgggctgctactcccaggtgaacccgaccaccctcacggccagcctggtcatgctgctcatccactacgccatcatcgggcccggcctgcaggccaaggcgacccgcgaggcccagaagcggaccgccgccggcatcatgaagaaccccaccgtggacgggatcacggtgatcgacctggagcccatctcctacgacccgaagttcgagaagcagctcggccaggtcatgctgctggtgctctgcgtggggcagctgctgctcatgcgcaccacctgggcgctgtgcgaggtcctgaccctcgccacgggccccatcatgaccctgtgggaggggaaccccggccggttctggaacaccaccatcgccgtgagcacggccaacatcttccgcggctcctacctggccggggcgggcctcgccttcagcctgatcaagaacgcccagacgccccggcgcgggaccggcaccacgggggagaccctgggcgagaagtggaagcggcagctcaactccctggaccgcaaggagttcgaggagtacaagcggagcggcatcctggaggtggaccgcaccgaggccaagtccgccctccgggacgggagcaagatcaagcacgcggtctcccgcggcagctccaagatccggtggatcgtggagcgcgggatgatcaagccgaagggcaaggtggtcgacctggggtgcggccggggcgggtggagctactacatggccaccctgaagaacgtgaccgaggtgaagggctacacgaagggcggccccgggcacgaggagcccatccccatggccacctacggctggaacctcgtcaagctgcactccggcgtggacgtgttctacaagccgaccgagcaggtcgacaccctgctctgcgacatcggggagagctccagcaaccccacgatcgaggagggccgcaccctgcgcatcctgaagatggtggagccctggctcagctccaagcccgagttctgcatcaaggtgctgaacccgtacatgcccaccgtcatcgaggagctggagaagctccagcggcgccacgggggcagcctggtgcggtgccccctgtcccgcaacagcacccacgagatgtactgggtgtccggcgccagcgggaacatcgtctccagcgtgaacacgatctccaagatgctgctcaaccggttcaccacccgccaccggaagcccacctacgagaaggacgtcgacctgggcgccgggacgcgcagcgtgtccaccgagaccgagaagccggacatgaccatcatcggccggcgcctgcagcggctccaggaggagcacaaggagacgtggcactacgaccaggagaacccctaccgcacctgggcgtaccacgggagctacgaggccccctccaccggcagcgcctccagcatggtgaacggcgtcgtgaagctgctgaccaagccgtgggacgtgatccccatggtcacgcagctcgccatgaccgacaccacccccttcgggcagcagcgggtgttcaaggagaaggtggacacgcgcacgccccagccgaagctgggcacccggatgatcatgaccacgaccgcgaactggctgtgggccctcctggggaagaagaagtccccgcggctgtgcacccgggaggagttcatcagcaaggtccgcagcaacgccgccatcggcgccgtgttccaggaggagcaggggtggaccagcgcgagcgaggccgtgaacgactcccggttctgggagctcgtcgacaaggagcgcgccctgcaccaggagggcaagtgcgagagctgcgtgtacaacatgatgggcaagcgggagaagaagctgggggagttcggccgcgccaaggggtcccgcgccatctggtacatgtggctcggcgcgcggttcctggagttcgaggccctggggttcctcaacgaggaccactggttcagccgcgagaactcctggagcggcgtggagggcgaggggctgcaccggctgggctacatcctcgaggacatcgacaagaaggacggggacctgatctacgccgacgacacggccggctgggacacccgcatcaccgaggacgacctgctcaacgaggagctgatcaccgagcagatggcgccccaccacaagacgctggcgaaggccatcttcaagctcacctaccagaacaaggtcgtgaaggtgctgcggcccacccccaagggcgccgtcatggacatcatctcccgcaaggaccagcgggggagcggccaggtggggacctacggcctgaacaccttcacgaacatggaggtgcagctcatccgccagatggaggccgagggggtcatcacccaggacgacatgcagaaccccaagggcctgaaggagcgggtggagaagtggctgaaggagtgcggcgtggaccgcctcaagcggatggcgatctccggggacgactgcgtcgtgaagcccctggacgagcgcttcagcacctccctcctgttcctgaacgacatgggcaaggtgcggaaggacgtcccccagtgggagccgagcaaggggtggaagaactggcaggaggtgcccttctgctcccaccacttccacaagatcttcatgaaggacggccgcagcctggtggtcccctgccggaaccaggacgagctcatcgggcgcgcccggatctcccagggcgccggctggagcctgcgcgagaccgcctgcctggggaaggcctacgcgcagatgtggtccctcatgtacttccaccggcgcgacctgcgcctggccagcatggccatctgcagcgccgtgcccacggagtggttcccgacctcccggaccacctggagcatccacgcccagcaccagtggatgacgaccgaggacatgctcaaggtgtggaaccgcgtctggatcgaggacaaccccaacatgaccgacaagacccccgtgcactcctgggaggacatcccctacctgggcaagcgggaggacctgtggtgcgggagcctcatcggcctgtccagccgcgcgacgtgggccaagaacatccacaccgccatcacccaggtgcggaacctgatcgggaaggaggagtacgtcgactacatgccggtgatgaagcgctactccgcccccagcgagtccgagggcgtgctctga

SEQ ID NO: 10498 - RNA, 9867 nt, synthetic construct
  misc_feature 1..9867: note = derived and/or modified CDS sequence (opt1) from DENV-4__JQ915082__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcatcgtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcacgaccatggcccagggcaagcccaccctggacttcgagctcaccaagacgaccgccaaggaggtggccctgctgcggacctactgcatcgaggcctccatcagcaacatcaccacggcgacccgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcctgtgctccggcaagatcacggggaacctcgtccagatcgagaacctggagtacaccgtggtggtcaccgtgcacaacggcgacacccacgccgtcggcaacgacacgagcaaccacggggtgaccgccaccatcacgccccggtcccccagcgtggaggtcaagctgccggactacggcgagctcacgctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcaccttcaaggtgccgcacgccaagcggcaggacgtgacggtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacccagcacgggacgaccgtcgtgaaggtgaagtacgagggcgccggggccccctgcaagatccccatcgagatccgggacgtcaacaaggagaaggtggtgggccgcatcatcagctccacccccttcgcggagaacaccaacagcgtcatcaacatcgagctggagccgcccttcggggactcctacatcgtgatcggcgtgggcgacagcgccctcacgctgcactggttccggaaggggtccagcatcggcaagatgttcgagtccacctaccgcggggccaagcggatggccatcctgggcgagaccgcgtgggacttcgggagcgtcggcggcctcttcacctccctggggaaggccgtgcaccaggtgttcggcagcgtctacacgaccatgttcgggggcgtgtcctggatgatccgcatcctgatcgggttcctcgtgctgtggatcggcaccaacagccggaacacctccatggccatgacgtgcatcgccgtcggcgggatcaccctgttcctgggcttcaccgtgcaggccgacatggggtgcgtggtcagctggaacggcaaggagctcaagtgcgggtccggcatcttcgtggtggacaacgtccacacctggacggagcagtacaagttccagcccgagagccccgcgcgcctggccagcgccatcctgaacgcccacaaggacggcgtgtgcgggatccggtccaccacccgcctcgagaacgtgatgtggaagcagatcaccaacgagctgaactacgtcctgtgggagggcgggcacgacctcacggtggtggccggcgacgtcaagggcgtgctgaccaaggggaagcgggcgctgaccccgcccgtgaacgacctcaagtacagctggaagacctggggcaaggccaagatcttcacgcccgaggcccgcaactccaccttcctgatcgacgggcccgacaccagcgagtgcccgaacgagcggcgcgcctggaacttcttcgaggtcgaggactacggcttcgggatgttcaccacgaacatctggatgaagttccgggagggctccagcgaggtgtgcgaccaccgcctgatgtccgccgcgatcaaggaccagaaggccgtgcacgccgacatgggctactggatcgagagctccaagaaccagacctggcagatcgagaaggccagcctcatcgaggtcaagacctgcctgtggcccaagacccacacgctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcaccaccgtgaagatccaggaggactgcgaccaccgggggccctccctgcgcacgaccaccgccagcggcaagctggtcacccagtggtgctgccgctcctgcacgatgccgcccctccggttcctgggggaggacggctgctggtacgggatggagatccgccccctgagcgagaaggaggagaacatggtcaagagccaggtgaccgccggccagggcacctccgagaccttcagcatggggctcctgtgcctgaccctcttcgtcgaggagtgcctgcggcgccgggtgacccgcaagcacatgatcctggtcgtggtgatcaccttctgcgcgatcatcctcggcgggctgacctggatggacctgctccgggccctgatcatgctgggcgacacgatgtccggccgcatcgggggccagatccacctcgccatcatgaccgtcttcaagatgagccccgggtacgtgctgggcgtgttcctgcggaagctcacctcccgcgagaccgccctgatggtcatcgggatggccatgacgaccgtgttcagcatcccgcacgacctgatggagctcatcgacggcatctccctgggcctgatcctcctgaagatcgtgacccacttcgacaacacccaggtcgggacgctggcgctcagcctgaccttcatccggtccaccacgcccctggtgatggcctggcgcacgatcatggccgtgttcttcgtcatcaccctcatccccctgtgccggaccagctgcctgcagaagcagtcccactgggtggagatcaccgccctcatcctgggcgcccaggcgctgcccgtgtacctcatgacgctgatgaagggggccagccgccggtcctggccgctgaacgagggcatcatggccgtcgggctcgtgagcctgctgggctccgccctcctgaagaacgacgtgcccctggcgggccccatggtcgccgggggcctcctgctggccgcctacgtgatgagcgggtccagcgccgacctctccctggagaaggcggccaacgtgcagtgggacgagatggccgacatcaccggcagcagccccatcatcgaggtcaagcaggacgaggacgggtccttcagcatccgcgacgtggaggagaccaacatgatcaccctgctcgtgaagctggccctgatcacggtctccggcctctacccgctggccatccccgtgaccatggcgctgtggtacatctggcaggtcaagacccagcggagcggcgccctctgggacgtcccctcccccgccgccacccagaaggccacgctgagcgagggggtgtaccgcatcatgcagcggggcctgttcgggaagacccaggtgggcgtcgggatccacatggagggcgtgttccacaccatgtggcacgtgacccgcggctccgtcatctgccacgagaccgggcggctcgagccgagctgggcggacgtgcgcaacgacatgatctcctacggcgggggctggcgcctgggcgacaagtgggacaaggaggaggacgtgcaggtcctggccatcgagcccgggaagaacccccggcacgtgcagacgaagcccggcctcttcaagaccctgaccggggagatcggcgccgtgaccctggacttcaagccggggacgagcggctcccccatcatcaacaagaagggcaaggtcatcgggctctacggcaacggggtggtgaccaagagcggcgactacgtctccgccatcacccaggccgagcgcatcggggagcccgactacgaggtggacgaggacatcttccggaagaagcgcctgaccatcatggacctgcacccgggcgcgggcaagacgaagcggatcctccccagcatcgtgcgcgaggccctgaagcggcgcctgcggaccctcatcctggcccccacccgcgtcgtggccgcggagatggaggaggccctgcgggggctgcccatccgctaccagaccccggccgtgaagtccgagcacacgggccgggagatcgtcgacctcatgtgccacgccaccttcaccacccgcctgctgagctccacgcgggtgcccaactacaacctcatcgtgatggacgaggcccacttcaccgacccctgcagcgtcgcggcccgcgggtacatctccacccgggtggagatgggcgaggccgccgccatcttcatgaccgcgacgcccccggggagcatcgaccccttcccccagagcaactcccccatcgaggacatcgagcgcgagatcccggagcggagctggaacaccggcttcgactggatcaccgactaccagggcaagaccgtctggttcgtgccctccatcaaggccgggaacgacatcgccaactgcctgcgcaagagcggcaagcgcgtgatccagctgtcccggaagacgttcgacaccgagtaccccaagaccaagctcaccgactgggacttcgtcgtgacgaccgacatcagcgagatgggggccaacttccgcgccggccgggtgatcgacccccgccggtgcctgaagccggtcatcctgaccgacgggcccgagcgcgtgatcctcgcgggccccatccccgtgaccccggcctccgccgcccagcggcgcggccggatcgggcgcaaccccgcgcaggaggacgaccagtacgtcttcagcggcgaccccctgaagaacgacgaggaccacgcccactggacggaggccaagatgctgctcgacaacatctacacccccgaggggatcatcccgaccctgttcggccccgagcgggagaagacccaggccatcgacggcgagttccgcctgcgcggggagcagcgcaagacgttcgtggagctcatgcggcgcggcgacctgcccgtgtggctgtcctacaaggtcgccagcgcggggatctcctacaaggaccgggagtggtgcttcaccggcgagcgcaacaaccagatcctcgaggagaacatggaggtggagatctggacccgggagggggagaagaagaagctgcgccccaagtggctggacgcccgggtgtacgccgacccgatggccctcaaggacttcaaggagttcgccagcggccgcaagtccaccacgctggacatcctgaccgagatcgcgaccctccccacctacctgagctccaaggccaagctggccctcgacaacatcgtcatgctgcacaccacggagaagggcgggcgcgcctaccagcacgccctgaacgagctccccgagagcctggagaccctgatgctcgtggcgctgctgggcgccatgaccgccgggatcttcctcttcttcatgcagggcaaggggatcggcaagctgtccatgggcctgatcgccatcgcggtggccagcgggctcctgtgggtcgccgagatccagccgcagtggatcgccgcctccatcatcctggagttcttcctcatggtgctgctgatccccgagcccgagaagcagcggacgccccaggacaaccagctcatctacgtgatcctgacgatcctgaccatcatcggcctcatcgcggccaacgagatggggctgatcgagaagaccaagaccgacttcggcttctaccaggtcaagacggagaccaccatcctggacgtggacctccgcccggccagcgcctggaccctgtacgccgtggcgacgaccatcctgacccccatgctccggcacaccatcgagaacatgagcgccaacctgtccctggccgccatcgccaaccaggcggccgtcctcatggggctgggcaagggctggcccctgcaccgcatggacctcggggtgcccctgctggccatgggctgctacagccaggtgaacccgacgaccctcaccgcctccctggtcatgctgctcatccactacgccatcatcgggcccggcctgcaggcgaaggccacccgggaggcccagaagcgcacggccgcgggcatcatgaagaaccccaccgtggacgggatcaccgtgatcgacctggagcccatcagctacgacccgaagttcgagaagcagctcggccaggtcatgctgctggtgctctgcgtggggcagctgctgctcatgcggaccacgtgggccctgtgcgaggtcctgaccctcgccaccggccccatcatcaccctgtgggaggggaaccccggccgcttctggaacacgaccatcgccgtgtccaccgccaacatcttccggggcagctacctggcgggggccggcctcgccttctccctgatcaagaacgcccagacgccccgccgggggacgggcaccaccggggagaccctgggcgagaagtggaagcgccagctcaacagcctggaccggaaggagttcgaggagtacaagcgctccggcatcctggaggtggaccggacggaggccaagagcgcgctccgcgacgggtccaagatcaagcacgccgtcagccggggctccagcaagatccgctggatcgtggagcgggggatgatcaagccgaagggcaaggtggtcgacctggggtgcggccgcggcgggtggtcctactacatggccaccctgaagaacgtgaccgaggtgaagggctacaccaagggcggccccgggcacgaggagcccatccccatggccacctacggctggaacctcgtcaagctgcacagcggcgtggacgtgttctacaagccgacggagcaggtcgacaccctgctctgcgacatcggggagtccagctccaaccccaccatcgaggagggccgcaccctgcggatcctgaagatggtggagccctggctcagcagcaagcccgagttctgcatcaaggtgctgaacccgtacatgcccacggtcatcgaggagctggagaagctccagcgccggcacgggggctccctggtgcgctgccccctgagccggaactccacccacgagatgtactgggtgagcggcgcctccgggaacatcgtcagctccgtgaacaccatcagcaagatgctgctcaaccgcttcaccacgcggcaccgcaagcccacctacgagaaggacgtcgacctgggcgcggggacccggtccgtgagcaccgagacggagaagccggacatgaccatcatcggccgccggctgcagcgcctccaggaggagcacaaggagacctggcactacgaccaggagaacccctaccggacctgggcctaccacgggtcctacgaggcccccagcacgggctccgccagctccatggtgaacggcgtcgtgaagctgctgaccaagccgtgggacgtgatccccatggtcacccagctcgcgatgaccgacacgacccccttcgggcagcagcgcgtgttcaaggagaaggtggacacccggacgccccagccgaagctgggcacgcgcatgatcatgaccaccaccgccaactggctgtgggccctcctggggaagaagaagtccccgcggctgtgcacgcgcgaggagttcatctccaaggtccggagcaacgccgccatcggcgcggtgttccaggaggagcaggggtggacctccgccagcgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggcgatctggtacatgtggctcggcgcccgcttcctggagttcgaggccctggggttcctcaacgaggaccactggttctcccgggagaacagctggtccggcgtggagggcgaggggctgcaccgcctgggctacatcctcgaggacatcgacaagaaggacggggacctgatctacgccgacgacaccgccggctgggacacccggatcacggaggacgacctgctcaacgaggagctgatcaccgagcagatggcgccccaccacaagaccctggccaaggccatcttcaagctcacctaccagaacaaggtcgtgaaggtgctgcgccccacgcccaagggcgccgtcatggacatcatcagccggaaggaccagcgcgggtccggccaggtggggacctacggcctgaacaccttcaccaacatggaggtgcagctcatccggcagatggaggcggagggggtcatcacccaggacgacatgcagaaccccaagggcctgaaggagcgcgtggagaagtggctgaaggagtgcggcgtggaccggctcaagcgcatggccatcagcggggacgactgcgtcgtgaagcccctggacgagcggttctccacgagcctcctgttcctgaacgacatgggcaaggtgcgcaaggacgtcccccagtgggacccgtccaaggggtggaagaactggcaggaggtgcccttctgcagccaccacttccacaagatcttcatgaaggacggccggtccctggtggtcccctgccgcaaccaggacgagctcatcgggcgggcccgcatcagccagggcgccggctggtccctgcgggagaccgcctgcctggggaaggcgtacgcccagatgtggagcctcatgtacttccaccgccgcgacctgcggctggcctccatggccatctgcagcgccgtgcccaccgagtggttcccgaccagccgcacgacctggtccatccacgcgcagcaccagtggatgaccaccgaggacatgctcaaggtgtggaaccgggtctggatcgaggacaaccccaacatgacggacaagacccccgtgcacagctgggaggacatcccctacctgggcaagcgcgaggacctgtggtgcgggtccctcatcggcctgagctcccgggccacctgggccaagaacatccacaccgccatcacccaggtgcgcaacctgatcgggaaggaggagtacgtcgactacatgccggtgatgaagcggtacagcgccccctccgagagcgagggcgtgctctga

SEQ ID NO: 10499 - RNA, 9867 nt, synthetic construct
  misc_feature 1..9867: note = derived and/or modified CDS sequence (opt1) from DENV-4__JQ915081__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcatcgtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcacgaccatggcccagggcaagcccaccctggacttcgagctcaccaagacgaccgccaaggaggtggccctgctgcggacctactgcatcgaggcctccatcagcaacatcaccacggcgacccgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcctgtgctccggcaagatcacggggaacctcgtccagatcgagaacctggagtacaccgtggtggtcaccgtgcacaacggcgacacccacgccgtcggcaacgacacgagcaaccacggggtgaccgccaccatcacgccccggtcccccagcgtggaggtcaagctgccggactacggcgagctcacgctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcaccttcaaggtgccgcacgccaagcggcaggacgtgacggtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacccagcacgggacgaccgtcgtgaaggtgaagtacgagggcgccggggccccctgcaagatccccatcgagatccgggacgtcaacaaggagaaggtggtgggccgcatcatcagctccacccccttcgcggagaacaccaacagcgtcatcaacatcgagctggagccgcccttcggggactcctacatcgtgatcggcgtgggcgacagcgccctcacgctgcactggttccggaaggggtccagcatcggcaagatgttcgagtccacctaccgcggggccaagcggatggccatcctgggcgagaccgcgtgggacttcgggagcgtcggcggcctcttcacctccctggggaaggccgtgcaccaggtgttcggcagcgtctacacgaccatgttcgggggcgtgtcctggatgatccgcatcctgatcgggttcctcgtgctgtggatcggcaccaacagccggaacacctccatggccatgacgtgcatcgccgtcggcgggatcaccctgttcctgggcttcaccgtgcaggccgacatggggtgcgtggtcagctggaacggcaaggagctcaagtgcgggtccggcatcttcgtggtggacaacgtccacacctggacggagcagtacaagttccagcccgagagccccgcgcgcctggccagcgccatcctgaacgcccacaaggacggcgtgtgcgggatccggtccaccacccgcctcgagaacgtgatgtggaagcagatcaccaacgagctgaactacgtcctgtgggagggcgggcacgacctcacggtggtggccggcgacgtcaagggcgtgctgaccaaggggaagcgggcgctgaccccgcccgtgaacgacctcaagtacagctggaagacctggggcaaggccaagatcttcacgcccgaggcccgcaactccaccttcctgatcgacgggcccgacaccagcgagtgcccgaacgagcggcgcgcctggaacttcttcgaggtcgaggactacggcttcgggatgttcaccacgaacatctggatgaagttccgggagggctccagcgaggtgtgcgaccaccgcctgatgtccgccgcgatcaaggaccagaaggccgtgcacgccgacatgggctactggatcgagagctccaagaaccagacctggcagatcgagaaggccagcctcatcgaggtcaagacctgcctgtggcccaagacccacacgctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcaccaccgtgaagatccaggaggactgcgaccaccgggggccctccctgcgcacgaccaccgccagcggcaagctggtcacccagtggtgctgccgctcctgcacgatgccgcccctccggttcctgggggaggacggctgctggtacgggatggagatccgccccctgagcgagaaggaggagaacatggtcaagagccaggtgaccgccggccagggcacctccgagaccttcagcatggggctcctgtgcctgaccctcttcgtcgaggagtgcctgcggcgccgggtgacccgcaagcacatgatcctggtcgtggtgatcaccttctgcgcgatcatcctcggcgggctgacctggatggacctgctccgggccctgatcatgctgggcgacacgatgtccggccgcatcgggggccagatccacctcgccatcatgaccgtcttcaagatgagccccgggtacgtgctgggcgtgttcctgcggaagctcacctcccgcgagaccgccctgatggtcatcgggatggccatgacgaccgtgttcagcatcccgcacgacctgatggagctcatcgacggcatctccctgggcctgatcctcctgaagatcgtgacccacttcgacaacacccaggtcgggacgctggcgctcagcctgaccttcatccggtccaccacgcccctggtgatggcctggcgcacgatcatggccgtgttcttcgtcatcaccctcatccccctgtgccggaccagctgcctgcagaagcagtcccactgggtggagatcaccgccctcatcctgggcgcccaggcgctgcccgtgtacctcatgacgctgatgaagggggccagccgccggtcctggccgctgaacgagggcatcatggccgtcgggctcgtgagcctgctgggctccgccctcctgaagaacgacgtgcccctggcgggccccatggtcgccgggggcctcctgctggccgcctacgtgatgagcgggtccagcgccgacctctccctggagaaggcggccaacgtgcagtgggacgagatggccgacatcaccggcagcagccccatcatcgaggtcaagcaggacgaggacgggtccttcagcatccgcgacgtggaggagaccaacatgatcaccctgctcgtgaagctggccctgatcacggtctccggcctctacccgctggccatccccgtgaccatggcgctgtggtacatctggcaggtcaagacccagcggagcggcgccctctgggacgtcccctcccccgccgccacccagaaggccacgctgagcgagggggtgtaccgcatcatgcagcggggcctgttcgggaagacccaggtgggcgtcgggatccacatggagggcgtgttccacaccatgtggcacgtgacccgcggctccgtcatctgccacgagaccgggcggctcgagccgagctgggcggacgtgcgcaacgacatgatctcctacggcgggggctggcgcctgggcgacaagtgggacaaggaggaggacgtgcaggtcctggccatcgagcccgggaagaacccccggcacgtgcagacgaagcccggcctcttcaagaccctgaccggggagatcggcgccgtgaccctggacttcaagccggggacgagcggctcccccatcatcaacaagaagggcaaggtcatcgggctctacggcaacggggtggtgaccaagagcggcgactacgtctccgccatcacccaggccgagcgcatcggggagcccgactacgaggtggacgaggacatcttccggaagaagcgcctgaccatcatggacctgcacccgggcgcgggcaagacgaagcggatcctccccagcatcgtgcgcgaggccctgaagcggcgcctgcggaccctcatcctggcccccacccgcgtcgtggccgcggagatggaggaggccctgcgggggctgcccatccgctaccagaccccggccgtgaagtccgagcacacgggccgggagatcgtcgacctcatgtgccacgccaccttcaccacccgcctgctgagctccacgcgggtgcccaactacaacctcatcgtgatggacgaggcccacttcaccgacccctgcagcgtcgcggcccgcgggtacatctccacccgggtggagatgggcgaggccgccgccatcttcatgaccgcgacgcccccggggagcatcgaccccttcccccagagcaactcccccatcgaggacatcgagcgcgagatcccggagcggagctggaacaccggcttcgactggatcaccgactaccagggcaagaccgtctggttcgtgccctccatcaaggccgggaacgacatcgccaactgcctgcgcaagagcggcaagcgcgtgatccagctgtcccggaagacgttcgacaccgagtaccccaagaccaagctcaccgactgggacttcgtcgtgacgaccgacatcagcgagatgggggccaacttccgcgccggccgggtgatcgacccccgccggtgcctgaagccggtcatcctgaccgacgggcccgagcgcgtgatcctcgcgggccccatccccgtgaccccggcctccgccgcccagcggcgcggccggatcgggcgcaaccccgcgcaggaggacgaccagtacgtcttcagcggcgaccccctgaagaacgacgaggaccacgcccactggacggaggccaagatgctgctcgacaacatctacacccccgaggggatcatcccgaccctgttcggccccgagcgggagaagacccaggccatcgacggcgagttccgcctgcgcggggagcagcgcaagacgttcgtggagctcatgcggcgcggcgacctgcccgtgtggctgtcctacaaggtcgccagcgcggggatctcctacaaggaccgggagtggtgcttcaccggcgagcgcaacaaccagatcctcgaggagaacatggaggtggagatctggacccgggagggggagaagaagaagctgcgccccaagtggctggacgcccgggtgtacgccgacccgatggccctcaaggacttcaaggagttcgccagcggccgcaagtccaccacgctggacatcctgaccgagatcgcgaccctccccacctacctgagctccaaggccaagctggccctcgacaacatcgtcatgctgcacaccacggagaagggcgggcgcgcctaccagcacgccctgaacgagctccccgagagcctggagaccctgatgctcgtggcgctgctgggcgccatgaccgccgggatcttcctcttcttcatgcagggcaaggggatcggcaagctgtccatgggcctgatcgccatcgcggtggccagcgggctcctgtgggtcgccgagatccagccgcagtggatcgccgcctccatcatcctggagttcttcctcatggtgctgctgatccccgagcccgagaagcagcggacgccccaggacaaccagctcatctacgtgatcctgacgatcctgaccatcatcggcctcatcgcggccaacgagatggggctgatcgagaagaccaagaccgacttcggcttctaccaggtcaagacggagaccaccatcctggacgtggacctccgcccggccagcgcctggaccctgtacgccgtggcgacgaccatcctgacccccatgctccggcacaccatcgagaacatgagcgccaacctgtccctggccgccatcgccaaccaggcggccgtcctcatggggctgggcaagggctggcccctgcaccgcatggacctcggggtgcccctgctggccatgggctgctacagccaggtgaacccgacgaccctcaccgcctccctggtcatgctgctcatccactacgccatcatcgggcccggcctgcaggcgaaggccacccgggaggcccagaagcgcacggccgcgggcatcatgaagaaccccaccgtggacgggatcaccgtgatcgacctggagcccatcagctacgacccgaagttcgagaagcagctcggccaggtcatgctgctggtgctctgcgtggggcagctgctgctcatgcggaccacgtgggccctgtgcgaggtcctgaccctcgccaccggccccatcatcaccctgtgggaggggaaccccggccgcttctggaacacgaccatcgccgtgtccaccgccaacatcttccggggcagctacctggcgggggccggcctcgccttctccctgatcaagaacgcccagacgccccgccgggggacgggcaccaccggggagaccctgggcgagaagtggaagcgccagctcaacagcctggaccggaaggagttcgaggagtacaagcgctccggcatcctggaggtggaccggacggaggccaagagcgcgctccgcgacgggtccaagatcaagcacgccgtcagccggggctccagcaagatccgctggatcgtggagcgggggatgatcaagccgaagggcaaggtggtcgacctggggtgcggccgcggcgggtggtcctactacatggccaccctgaagaacgtgaccgaggtgaagggctacaccaagggcggccccgggcacgaggagcccatccccatggccacctacggctggaacctcgtcaagctgcacagcggcgtggacgtgttctacaagccgacggagcaggtcgacaccctgctctgcgacatcggggagtccagctccaaccccaccatcgaggagggccgcaccctgcggatcctgaagatggtggagccctggctcagcagcaagcccgagttctgcatcaaggtgctgaacccgtacatgcccacggtcatcgaggagctggagaagctccagcgccggcacgggggctccctggtgcgctgccccctgagccggaactccacccacgagatgtactgggtgagcggcgcctccgggaacatcgtcagctccgtgaacaccatcagcaagatgctgctcaaccgcttcaccacgcggcaccgcaagcccacctacgagaaggacgtcgacctgggcgcggggacccggtccgtgagcatcgagaccgagaagccggacatgacgatcatcggccgccggctgcagcgcctccaggaggagcacaaggagacctggcactacgaccaggagaacccctaccggacctgggcctaccacgggtcctacgaggcccccagcaccggctccgccagctccatggtgaacggcgtcgtgaagctgctgacgaagccgtgggacgtgatccccatggtcacccagctcgcgatgaccgacaccacgcccttcgggcagcagcgcgtgttcaaggagaaggtggacacccggacgccccagccgaagctgggcacccgcatgatcatgacgaccaccgccaactggctgtgggccctcctggggaagaagaagtccccgcggctgtgcacccgcgaggagttcatctccaaggtccggagcaacgccgccatcggcgcggtgttccaggaggagcaggggtggacgtccgccagcgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggcgatctggtacatgtggctcggcgcccgcttcctggagttcgaggccctggggttcctcaacgaggaccactggttctcccgggagaacagctggtccggcgtggagggcgaggggctgcaccgcctgggctacatcctcgaggacatcgacaagaaggacggggacctgatctacgccgacgacaccgccggctgggacacccggatcaccgaggacgacctgctcaacgaggagctgatcacggagcagatggcgccccaccacaagaccctggccaaggccatcttcaagctcacctaccagaacaaggtcgtgaaggtgctgcgccccacccccaagggcgccgtcatggacatcatcagccggaaggaccagcgcgggtccggccaggtggggacgtacggcctgaacaccttcaccaacatggaggtgcagctcatccggcagatggaggcggagggggtcatcacccaggacgacatgcagaaccccaagggcctgaaggagcgcgtggagaagtggctgaaggagtgcggcgtggaccggctcaagcgcatggccatcagcggggacgactgcgtcgtgaagcccctggacgagcggttctccaccagcctcctgttcctgaacgacatgggcaaggtgcgcaaggacgtcccccagtgggacccgtccaaggggtggaagaactggcaggaggtgcccttctgcagccaccacttccacaagatcttcatgaaggacggccggtccctggtggtcccctgccgcaaccaggacgagctcatcgggcgggcccgcatcagccagggcgccggctggtccctgcgggagacggcctgcctggggaaggcgtacgcccagatgtggagcctcatgtacttccaccgccgcgacctgcggctggcctccatggccatctgcagcgccgtgcccaccgagtggttcccgaccagccgcaccacgtggtccatccacgcgcagcaccagtggatgaccaccgaggacatgctcaaggtgtggaaccgggtctggatcgaggacaaccccaacatgaccgacaagacgcccgtgcacagctgggaggacatcccctacctgggcaagcgcgaggacctgtggtgcgggtccctcatcggcctgagctcccgggccacctgggccaagaacatccacaccgccatcacccaggtgcgcaacctgatcgggaaggaggagtacgtcgactacatgccggtgatgaagcggtacagcgccccctccgagagcgagggcgtgctctga

SEQ ID NO: 10500 - RNA, 9867 nt, synthetic construct
  misc_feature 1..9867: note = derived and/or modified CDS sequence (opt1) from DENV-4__JQ915084__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcatcgtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcacgaccatggcccagggcaagcccaccctggacttcgagctcaccaagacgaccgccaaggaggtggccctgctgcggacctactgcatcgaggcctccatcagcaacatcaccacggcgacccgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcctgtgctccggcaagatcacggggaacctcgtccagatcgagaacctggagtacaccgtggtggtcaccgtgcacaacggcgacacccacgccgtcggcaacgacacgagcaaccacggggtgaccgccaccatcacgccccggtcccccagcgtggaggtcaagctgccggactacggcgagctcacgctggactgcgagccccggtccgggatcgacttcaacgagatgatcctgatgaagatgaagaagaagacctggctcgtgcacaagcagtggttcctggacctgcccctcccctggaccgccggcgcggacaccagcgaggtgcactggaactacaaggagcgcatggtcaccttcaaggtgccgcacgccaagcggcaggacgtgacggtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacccagcacgggacgaccgtcgtgaaggtgaagtacgagggcgccggggccccctgcaagatccccatcgagatccgggacgtcaacaaggagaaggtggtgggccgcatcatcagctccacccccttcgcggagaacaccaacagcgtcatcaacatcgagctggagccgcccttcggggactcctacatcgtgatcggcgtgggcgacagcgccctcacgctgcactggttccggaaggggtccagcatcggcaagatgttcgagtccacctaccgcggggccaagcggatggccatcctgggcgagaccgcgtgggacttcgggagcgtcggcggcctcttcacctccctggggaaggccgtgcaccaggtgttcggcagcgtctacacgaccatgttcgggggcgtgtcctggatgatccgcatcctgatcgggttcctcgtgctgtggatcggcaccaacagccggaacacctccatggccatgacgtgcatcgccgtcggcgggatcaccctgttcctgggcttcaccgtgcaggccgacatggggtgcgtggtcagctggaacggcaaggagctcaagtgcgggtccggcatcttcgtggtggacaacgtccacacctggacggagcagtacaagttccagcccgagagccccgcgcgcctggccagcgccatcctgaacgcccacaaggacggcgtgtgcgggatccggtccaccacccgcctcgagaacgtgatgtggaagcagatcaccaacgagctgaactacgtcctgtgggagggcgggcacgacctcacggtggtggccggcgacgtcaagggcgtgctgaccaaggggaagcgggcgctgaccccgcccgtgaacgacctcaagtacagctggaagacctggggcaaggccaagatcttcacgcccgaggcccgcaactccaccttcctgatcgacgggcccgacaccagcgagtgcccgaacgagcggcgcgcctggaacttcttcgaggtcgaggactacggcttcgggatgttcaccacgaacatctggatgaagttccgggagggctccagcgaggtgtgcgaccaccgcctgatgtccgccgcgatcaaggaccagaaggccgtgcacgccgacatgggctactggatcgagagctccaagaaccagacctggcagatcgagaaggccagcctcatcgaggtcaagacctgcctgtggcccaagacccacacgctgtggtccaacggggtgctcgagagccagatgctgatcccccggtcctacgcgggcccgttcagccagcacaactaccgccaggggtacgccacccagaccgccggcccctggcacctggggaagctcgagatcgacttcggcgagtgccccggcaccaccgtgaagatccaggaggactgcgaccaccgggggccctccctgcgcacgaccaccgccagcggcaagctggtcacccagtggtgctgccgctcctgcacgatgccgcccctccggttcctgggggaggacggctgctggtacgggatggagatccgccccctgagcgagaaggaggagaacatggtcaagagccaggtgaccgccggccagggcacctccgagaccttcagcatggggctcctgtgcctgaccctcttcgtcgaggagtgcctgcggcgccgggtgacccgcaagcacatgatcctggtcgtggtgatcaccttctgcgcgatcatcctcggcgggctgacctggatggacctgctccgggccctgatcatgctgggcgacacgatgtccggccgcatcgggggccagatccacctcgccatcatgaccgtcttcaagatgagccccgggtacgtgctgggcgtgttcctgcggaagctcacctcccgcgagaccgccctgatggtcatcgggatggccatgacgaccgtgttcagcatcccgcacgacctgatggagctcatcgacggcatctccctgggcctgatcctcctgaagatcgtgacccacttcgacaacacccaggtcgggacgctggcgctcagcctgaccttcatgcggtccaccacgcccctggtgatggcctggcgcacgatcatggccgtgttcttcgtcatcaccctcatccccctgtgccggaccagctgcctgcagaagcagtcccactgggtggagatcaccgccctcatcctgggcgcccaggcgctgcccgtgtacctcatgacgctgatgaagggggccagccgccggtcctggccgctgaacgagggcatcatggccgtcgggctcgtgagcctgctgggctccgccctcctgaagaacgacgtgcccctggcgggccccatggtcgccgggggcctcctgctggccgcctacgtgatgagcgggtccagcgccgacctctccctggagaaggcggccaacgtgcagtgggacgagatggccgacatcaccggcagcagccccatcatcgaggtcaagcaggacgaggacgggtccttcagcatccgcgacgtggaggagaccaacatgatcaccctgctcgtgaagctggccctgatcacggtctccggcctctacccgctggccatccccgtgaccatggcgctgtggtacatctggcaggtcaagacccagcggagcggcgccctctgggacgtcccctcccccgccgccacccagaaggccacgctgagcgagggggtgtaccgcatcatgcagcggggcctgttcgggaagacccaggtgggcgtcgggatccacatggagggcgtgttccacaccatgtggcacgtgacccgcggctccgtcatctgccacgagaccgggcggctcgagccgagctgggcggacgtgcgcaacgacatgatctcctacggcgggggctggcgcctgggcgacaagtgggacaaggaggaggacgtgcaggtcctggccatcgagcccgggaagaacccccggcacgtgcagacgaagcccggcctcttcaagaccctgaccggggagatcggcgccgtgaccctggacttcaagccggggacgagcggctcccccatcatcaacaagaagggcaaggtcatcgggctctacggcaacggggtggtgaccaagagcggcgactacgtctccgccatcacccaggccgagcgcatcggggagcccgactacgaggtggacgaggacatcttccggaagaagcgcctgaccatcatggacctgcacccgggcgcgggcaagacgaagcggatcctccccagcatcgtgcgcgaggccctgaagcggcgcctgcggaccctcatcctggcccccacccgcgtcgtggccgcggagatggaggaggccctgcgggggctgcccatccgctaccagaccccggccgtgaagtccgagcacacgggccgggagatcgtcgacctcatgtgccacgccaccttcaccacccgcctgctgagctccacgcgggtgcccaactacaacctcatcgtgatggacgaggcccacttcaccgacccctgcagcgtcgcggcccgcgggtacatctccacccgggtggagatgggcgaggccgccgccatcttcatgaccgcgacgcccccggggagcatcgaccccttcccccagagcaactcccccatcgaggacatcgagcgcgagatcccggagcggagctggaacaccggcttcgactggatcaccgactaccagggcaagaccgtctggttcgtgccctccatcaaggccgggaacgacatcgccaactgcctgcgcaagagcggcaagcgcgtgatccagctgtcccggaagacgttcgacaccgagtaccccaagaccaagctcaccgactgggacttcgtcgtgacgaccgacatcagcgagatgggggccaacttccgcgccggccgggtgatcgacccccgccggtgcctgaagccggtcatcctgaccgacgggcccgagcgcgtgatcctcgcgggccccatccccgtgaccccggcctccgccgcccagcggcgcggccggatcgggcgcaaccccgcgcaggaggacgaccagtacgtcttcagcggcgaccccctgaagaacgacgaggaccacgcccactggacggaggccaagatgctgctcgacaacatctacacccccgaggggatcatcccgaccctgttcggccccgagcgggagaagacccaggccatcgacggcgagttccgcctgcgcggggagcagcgcaagacgttcgtggagctcatgcggcgcggcgacctgcccgtgtggctgtcctacaaggtcgccagcgcggggatctcctacaaggaccgggagtggtgcttcaccggcgagcgcaacaaccagatcctcgaggagaacatggaggtggagatctggacccgggagggggagaagaagaagctgcgccccaagtggctggacgcccgggtgtacgccgacccgatggccctcaaggacttcaaggagttcgccagcggccgcaagtccaccacgctggacatcctgaccgagatcgcgaccctccccacctacctgagctccaaggccaagctggccctcgacaacatcgtcatgctgcacaccacggagaagggcgggcgcgcctaccagcacgccctgaacgagctccccgagagcctggagaccctgatgctcgtggcgctgctgggcgccatgaccgccgggatcttcctcttcttcatgcagggcaaggggatcggcaagctgtccatgggcctgatcgccatcgcggtggccagcgggctcctgtgggtcgccgagatccagccgcagtggatcgccgcctccatcatcctggagttcttcctcatggtgctgctgatccccgagcccgagaagcagcggacgccccaggacaaccagctcatctacgtgatcctgacgatcctggcgatcatcggcctcatcgccgccaacgagatggggctgatcgagaagaccaagaccgacttcggcttctaccaggtcaagaccgagacgaccatcctggacgtggacctccgcccggccagcgcctggaccctgtacgcggtggccaccacgatcctgacccccatgctccggcacaccatcgagaacaccagcgccaacctgtccctggccgccatcgcgaaccaggccgccgtcctcatggggctgggcaagggctggcccctgcaccgcatggacctcggggtgcccctgctggccatgggctgctacagccaggtgaacccgacgaccctcaccgcctccctggtcatgctgctcatccactacgcgatcatcgggcccggcctgcaggccaaggccacccgggaggcccagaagcgcacggcggccggcatcatgaagaaccccaccgtggacgggatcaccgtgatcgacctggagcccatcagctacgacccgaagttcgagaagcagctcggccaggtcatgctgctggtgctctgcgtggggcagctgctgctcatgcggaccacgtgggccctgtgcgaggtcctgaccctcgccaccggccccatcatgaccctgtgggaggggaaccccggccgcttctggaacacgaccatcgccgtgtccaccgcgaacatcttccggggcagctacctggccggggccggcctcgccttctccctgatcaagaacgcccagacgccccgccgggggacgggcaccaccggggagaccctgggcgagaagtggaagcgccagctcaacagcctggaccggaaggagttcgaggagtacaagcgctccggcatcctggaggtggaccggacggaggccaagagcgccctccgcgacgggtccaagatcaagcacgccgtcagccggggctccagcaagatccgctggatcgtggagcgggggatgatcaagccgaagggcaaggtggtcgacctggggtgcggccgcggcgggtggtcctactacatggccaccctgaagaacgtgaccgaggtgaagggctacaccaagggcggccccgggcacgaggagcccatccccatggccacctacggctggaacctcgtcaagctgcacagcggcgtggacgtgttctacaagccgacggagcaggtcgacaccctgctctgcgacatcggggagtccagctccaaccccaccatcgaggagggccgcaccctgcggatcctgaagatggtggagccctggctcagcagcaagcccgagttctgcatcaaggtgctgaacccgtacatgcccacggtcatcgaggagctggagaagctccagcgccggcacgggggctccctggtgcgctgccccctgagccggaactccacccacgagatgtactgggtgagcggcgcgtccgggaacatcgtcagctccgtgaacaccatcagcaagatgctgctcaaccgcttcaccacgcggcaccgcaagcccacctacgagaaggacgtcgacctgggcgccgggacccggtccgtgagcaccgagacggagaagccggacatgaccatcatcggccgccggctgcagcgcctccaggaggagcacaaggagacctggcactacgaccaggagaacccctaccggacctgggcctaccacgggtcctacgaggcccccagcacgggctccgcgagctccatggtgaacggcgtcgtgaagctgctgaccaagccgtgggacgtgatccccatggtcacccagctcgccatgaccgacacgacccccttcgggcagcagcgcgtgttcaaggagaaggtggacacccggacgccccagccgaagatcggcacgcgcatgatcatgaccaccaccgccaactggctgtgggccctgctcgggaagaagaagtccccgcggctgtgcacgcgcgaggagttcatctccaaggtccggagcaacgccgcgatcggcgccgtgttccaggaggagcaggggtggacctccgccagcgaggccgtgaacgacagccgcttctgggagctggtcgacaaggagcgggccctccaccaggagggcaagtgcgagtcctgcgtgtacaacatgatgggcaagcgcgagaagaagctgggggagttcggccgcgcgaaggggagccgggccatctggtacatgtggctgggcgcccgcttcctcgagttcgaggccctggggttcctgaacgaggaccactggttctcccgggagaacagctggtccggcgtggagggcgaggggctccaccgcctgggctacatcctggaggacatcgacaagaaggacggggacctcatctacgccgacgacaccgcgggctgggacacccggatcacggaggacgacctgctgaacgaggagctcatcaccgagcagatggcgccccaccacaagaccctggccaaggccatcttcaagctgacctaccagaacaaggtcgtgaaggtgctccgccccacgcccaagggcgcggtcatggacatcatcagccggaaggaccagcgcgggtccggccaggtggggacctacggcctgaacaccttcaccaacatggaggtgcagctgatccggcagatggaggccgagggggtcatcacccaggacgacatgcagaaccccaagggcctcaaggagcgcgtggagaagtggctgaaggagtgcggcgtggaccggctgaagcgcatggccatcagcggggacgactgcgtcgtgaagcccctcgacgagcggttctccacgagcctgctgttcctcaacgacatgggcaaggtgcgcaaggacgtcccccagtgggagccgtccaaggggtggaagaactggcaggaggtgcccttctgcagccaccacttccacaagatcttcatgaaggacggccggtccctggtggtcccctgccgcaaccaggacgagctgatcgggcgggcccgcatcagccagggcgccggctggtccctccgggagaccgcgtgcctggggaaggcctacgcccagatgtggagcctgatgtacttccaccgccgcgacctccggctggcctccatggccatctgcagcgcggtgcccaccgagtggttcccgaccagccgcacgacctggtccatccacgcccagcaccagtggatgaccaccgaggacatgctgaaggtgtggaaccgggtctggatcgaggacaaccccaacatgacggacaagacccccgtgcacagctgggaggacatcccctacctcggcaagcgcgaggacctgtggtgcgggtccctgatcggcctcagctcccgggccacctgggccaagaacatccacaccgccatcacccaggtgcgcaacctgatcgggaaggaggagtacgtcgactacatgccggtgatgaagcggtacagctcccccagcgagtccgagggcgtgctgtga

SEQ ID NO: 10501 - RNA, 9867 nt, synthetic construct
  misc_feature 1..9867: note = derived and/or modified CDS sequence (opt1) from DENV-4__KM190936__SS-prME
  source 1..9867: mol_type = other RNA
agcaccatcaccctgctctgcctgatccccaccgtgatggccttctccctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgacctccacctgggtgatgtacgggacctgcacccagagcggggagcggcgccgggagaagcgctccgtggccctgaccccgcacagcggcatgggcctcgagacccgggccgagacctggatgtccagcgagggggcctggaagcacgcccagcgcgtggagtcctggatcctgcggaaccccggcttcgcgctgctcgccgggttcatggcctacatgatcggccagaccgggatccagcgcacggtgttcttcgtgctgatgatgctggtggcccccagctacggcatgcggtgcgtgggcgtggggaaccgcgacttcgtggagggcgtctccgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccagcatctccaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctggtccagatcgagaacctcgagtacaccgtggtggtcaccgtgcacaacggcgacacgcacgccgtcggcaacgacaccagcaaccacggggtgaccgccatgatcacgccccggtcccccagcgtggaggtcaagctgccggactacggcgagctgacgctcgactgcgagccccggtccgggatcgacttcaacgagatgatcctgatgaagatgaagaagaagacctggctggtgcacaagcagtggttcctcgacctgcccctgccctggaccgccggcgcggacaccagcgaggtgcactggaactacaaggagcgcatggtcaccttcaaggtgccgcacgccaagcggcaggacgtgacggtcctcgggagccaggagggcgccatgcactccgccctggccggcgcgaccgaggtggacagcggggacggcaaccacatgttcgccgggcacctgaagtgcaaggtgcgcatggagaagctccgcatcaagggcatgtcctacaccatgtgcagcggcaagttctccatcgacaaggagatggccgagacccagcacgggacgaccgtcgtgaaggtgaagtacgagggcgccggggccccctgcaaggtccccatcgagatccgggacgtgaacaaggagaaggtggtcggccgcatcatcagctccacgcccctggcggagaacaccaacagcgtgacgaacatcgagctggagccgcccttcggggactcctacatcgtgatcggcgtcggcaacagcgccctcaccctgcactggttccggaaggggtccagcatcggcaagatgttcgagtccacctaccgcggggccaagcggatggccatcctgggcgagaccgcgtgggacttcgggagcgtgggcggcctcttcacgtccctggggaaggccgtgcaccaggtcttcggcagcgtgtacaccaccatgttcgggggcgtgtcctggatgatccgcatcctgatcgggttcctcgtcctgtggatcggcaccaacagccggaacacgtccatggccatgacctgcatcgccgtgggcgggatcaccctgttcctgggcttcaccgtgcaggccgacatggggtgcgtcgtgagctggagcggcaaggagctcaagtgcgggtccggcatcttcgtggtcgacaacgtgcacacgtggaccgagcagtacaagttccagcccgagagccccgcgcgcctggcctccgccatcctgaacgcccacaaggacggcgtgtgcgggatccggagcaccacccgcctcgagaacgtcatgtggaagcagatcacgaacgagctgaactacgtgctgtgggagggcgggcacgacctcaccgtggtcgccggcgacgtgaagggcgtgctgaccaaggggaagcgggcgctgaccccgcccgtctccgacctcaagtacagctggaagacgtggggcaaggccaagatcttcacccccgaggcccgcaactccaccttcctgatcgacgggcccgacaccagcgagtgcccgaacgagcggcgcgcctggaactccctggaggtggaggactacggcttcgggatgttcacgaccaacatctggatgaagttccgggagggcagctccgaggtgtgcgaccaccgcctcatgagcgccgcgatcaaggaccagaaggccgtccacgccgacatgggctactggatcgagtccagcaagaaccagacctggcagatcgagaaggcctccctgatcgaggtgaagacctgcctgtggcccaagacgcacaccctctggagcaacggggtgctggagtcccagatgctgatccccaagagctacgcgggcccgttcagccagcacaactaccggcaggggtacgccacccagaccgtcggcccctggcacctcgggaagctggagatcgacttcggcgagtgccccggcaccacggtgaccatccaggaggactgcgaccaccgcgggccctccctgcggaccaccacggccagcggcaagctcgtgacccagtggtgctgccgctcctgcaccatgccgcccctgcgcttcctgggggaggacggctgctggtacgggatggagatccggcccctcagcgagaaggaggagaacatggtcaagtcccaggtgaccgccggccagggcacgagcgagaccttctccatggggctgctgtgcctcaccctgttcgtcgaggagtgcctgcgccggcgcgtgacccggaagcacatgatcctcgtggtcgtgatcacgctgtgcgccatcatcctgggcgggctcacctggatggacctgctgcgcgcgctcatcatgctgggcgacaccatgagcggccggatcgggggccagatccacctggccatcatggccgtgttcaagatgtcccccgggtacgtcctcggcgtgttcctgcgcaagctgaccagccgggagacggccctcatggtgatcgggatggccatgaccaccgtcctgtccatcccgcacgacctgatggagctcatcgacggcatcagcctgggcctgatcctcctgaagatcgtgacccagttcgacaacacccaggtggggaccctggcgctctccctgaccttcatccgcagcaccatgcccctggtcatggcctggcggacgatcatggccgtcctcttcgtggtcaccctgatccccctgtgccgcacctcctgcctccagaagcagagccactgggtggagatcaccgccctgatcctgggcgcccaggcgctccccgtgtacctgatgacgctgatgaagggggcctcccggcgcagctggccgctcaacgagggcatcatggccgtcgggctggtgtccctgctcggcagcgccctgctgaagaacgacgtgcccctcgcgggccccatggtcgccgggggcctgctgctcgccgcctacgtgatgagcgggtccagcgccgacctgtccctggagaaggcggccaacgtgcagtgggacgagatggccgacatcaccggcagctcccccatcatcgaggtcaagcaggacgaggacgggagcttctccatccgggacgtggaggagaccaacatgatcaccctcctggtgaagctggccctcatcacggtcagcggcctgtacccgctggccatccccgtgaccatgaccctctggtacatgtggcaggtcaagacccagcgctccggcgcgctgtgggacgtccccagccccgccgccacgcagaaggccgccctgtccgagggggtgtaccggatcatgcagcgcggcctcttcgggaagacccaggtgggcgtcgggatccacatggagggcgtgttccacaccatgtggcacgtgacccggggcagcgtcatctgccacgagaccgggcgcctggagccgtcctgggcggacgtgcggaacgacatgatcagctacggcgggggctggcgcctgggcgacaagtgggacaaggaggaggacgtgcaggtcctcgccatcgagcccgggaagaaccccaagcacgtgcagacgaagcccggcctgttcaagaccctgaccggggagatcggcgccgtgaccctcgacttcaagccggggacgtccggcagccccatcatcaaccgcaagggcaaggtcatcgggctgtacggcaacggggtggtgaccaagtccggcgactacgtcagcgccatcacccaggccgagcggatcggggagcccgactacgaggtggacgaggacatcttccgcaagaagcggctgaccatcatggacctccacccgggcgcgggcaagacgaagcgcatcctgccctccatcgtgcgggaggccctgaagcgccggctgcgcaccctcatcctggcccccacccgggtcgtggccgcggagatggaggaggccctgcgcgggctccccatccggtaccagaccccggccgtcaagagcgagcacacgggccgcgagatcgtcgacctgatgtgccacgccaccttcaccacccggctgctcagctccacgcgcgtgcccaactacaacctgatcgtcatggacgaggcccacttcaccgaccccagctccgtggcggcccgggggtacatcagcacccgcgtggagatgggcgaggccgccgccatcttcatgaccgcgacgcccccgggggccaccgaccccttcccccagtccaacagccccatcgaggacatcgagcgggagatcccggagcgctcctggaacaccggcttcgactggatcaccgactaccagggcaagacggtctggttcgtgcccagcatcaaggccgggaacgacatcgccaactgcctgcggaagtccggcaagaaggtgatccagctcagccgcaagaccttcgacaccgagtaccccaagaccaagctgacggactgggacttcgtcgtgaccaccgacatctccgagatgggggccaacttccgcgcgggccgggtgatcgacccccgccggtgcctgaagccggtcatcctcaccgacgggcccgagcgcgtgatcctggccggccccatccccgtgacgccggccagcgccgcgcagcggcgcggccggatcgggcgcaaccccgcccaggaggacgaccagtacgtcttctccggcgaccccctgaagaacgacgaggaccacgcccactggaccgaggccaagatgctcctggacaacatctacacccccgaggggatcatcccgaccctgttcggccccgagcgggagaagacgcaggccatcgacggcgagttccgcctccgcggggagcagcgcaagaccttcgtggagctgatgcggcgcggcgacctgcccgtgtggctcagctacaaggtcgcgtccgccgggatcagctacaaggaccgggagtggtgcttcaccggcgagcgcaacaaccagatcctggaggagaacatggaggtggagatctggacccgggagggggagaagaagaagctgcgcccccggtggctcgacgcccgcgtgtacgccgacccgatggccctgaaggacttcaaggagttcgcgtccggccgcaagagcatcacgctggacatcctcaccgagatcgcctccctgcccacctacctgagcagccgcgccaagctcgccctggacaacatcgtcatgctgcacaccaccgagcgcggcgggcgggcctaccagcacgcgctcaacgagctgcccgagtccctggagacgctcatgctggtggccctgctcggcgccatgaccgccgggatcttcctgttcttcatgcagggcaaggggatcggcaagctgagcatgggcctcatcaccatcgcggtggcctccgggctgctgtgggtcgccgagatccagccgcagtggatcgccgccagcatcatcctcgagttcttcctgatggtgctgctcatccccgagcccgagaagcagcgcacgccccaggacaaccagctgatctacgtgatcctgacgatcctcaccatcatcggcctgatcgcggccaacgagatggggctgatcgagaagaccaagaccgacttcggcttctaccaggtcaagacggagaccaccatcctcgacgtggacctgcggccggcctccgcctggaccctgtacgccgtggcgacgaccatcctcacccccatgctgcgccacaccatcgagaacacgagcgccaacctgtccctcgccgccatcgccaaccaggcggccgtcctgatggggctgggcaagggctggcccctccaccggatggacctgggggtgcccctgctcgccatgggctgctacagccaggtgaacccgaccaccctgaccgcctccctggtcatgctcctggtgcactacgccatcatcgggcccggcctgcaggcgaaggccacgcgcgaggcccagaagcggaccgccgcgggcatcatgaagaaccccaccgtggacgggatcaccgtcatcgacctcgagcccatcagctacgacccgaagttcgagaagcagctgggccaggtgatgctgctcgtgctgtgcgccgggcagctgctcctgatgcgcacgacctgggccttctgcgaggtcctgaccctcgccaccggccccatcctgacgctgtgggaggggaaccccggccggttctggaacaccaccatcgccgtgtccaccgcgaacatcttccgcggcagctacctcgccggggccggcctggccttctccctgatcaagaacgcccagacgccccggcgcgggaccggcaccaccggggagacgctcggcgagaagtggaagcggcagctgaacagcctggaccgcaaggagttcgaggagtacaagcggtccggcatcctcgaggtggaccgcaccgaggccaagagcgccctgaaggacgggtccaagatcaagcacgccgtcagccggggctccagcaagatccgctggatcgtggagcgggggatggtgaagccgaagggcaaggtcgtggacctggggtgcggccgcggcgggtggagctactacatggccaccctcaagaacgtgaccgaggtcaagggctacaccaagggcgggcccgggcacgaggagcccatccccatggccacgtacggctggaacctggtgaagctgcactccggcgtggacgtcttctacaagccgaccgagcaggtcgacaccctcctgtgcgacatcggggagagctccagcaaccccaccatcgaggagggccgcacgctgcgggtgctcaagatggtcgagccctggctgtccagcaagcccgagttctgcatcaaggtgctgaacccgtacatgcccaccgtcatcgaggagctggagaagctccagcgcaagcacgggggcaacctggtgcggtgccccctgtcccgcaacagcacccacgagatgtactgggtgtccggcgcgagcgggaacatcgtctccagcgtgaacaccacgtccaagatgctcctgaaccggttcaccacccgccaccggaagcccacctacgagaaggacgtggacctgggcgccgggacgcgcagcgtctccaccgagaccgagaagccggacatgaccatcatcggccggcgcctccagcggctgcaggaggagcacaaggagacgtggcactacgaccaggagaacccctaccgcacctgggcctaccacgggagctacgaggccccctccaccggcagcgcgtccagcatggtgaacggcgtggtcaagctgctcaccaagccgtgggacgtgatccccatggtgacgcagctggccatgaccgacaccacccccttcgggcagcagcgggtcttcaaggagaaggtggacacgcgcacgccccagccgaagcccggcacccggatggtgatgaccacgaccgccaactggctgtgggccctcctggggaagaagaagaacccccgcctgtgcacccgggaggagttcatcagcaaggtccgctccaacgccgcgatcggcgccgtgttccaggaggagcaggggtggaccagcgcctccgaggccgtgaacgacagccggttctgggagctcgtcgacaaggagcgcgccctgcaccaggagggcaagtgcgagtcctgcgtgtacaacatgatgggcaagcgggagaagaagctgggggagttcggccgcgcgaaggggagccgcgccatctggtacatgtggctcggcgcccggttcctggagttcgaggccctggggttcctcaacgaggaccactggttcggccgcgagaactcctggagcggcgtggagggggagggcctgcaccggctggggtacatcctcgaggagatcgacaagaaggacggcgacctgatgtacgccgacgacacggcgggctgggacacccgcatcaccgaggacgacctgcagaacgaggagctcatcaccgagcagatggcgccccaccacaagatcctggccaaggccatcttcaagctgacgtaccagaacaaggtcgtgaaggtgctccggccgacgccccgcggggcggtcatggacatcatctcccggaaggaccagcggggcagcggccaggtgggcacctacgggctgaacaccttcaccaacatggaggtgcagctgatccggcagatggaggccgagggcgtcatcacgcaggacgacatgcagaaccccaagggcctcaaggagcgcgtggagaagtggctgaaggagtgcggggtggaccggctgaagcgcatggccatctccggcgacgactgcgtcgtgaagcccctcgacgagcggttcgggaccagcctgctgttcctcaacgacatgggcaaggtgcgcaaggacatcccgcagtgggagccctccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgggagaccgcgtgcctggggaaggcctacgcccagatgtggagcctgatgtacttccaccgccgcgacctccggctggccagcatggccatctgctccgcggtcccgaccgagtggttccccacgagccgcaccacctggtccatccacgcccaccaccagtggatgaccacggaggacatgctgaaggtgtggaaccgggtgtggatcgaggacaaccccaacatgaccgacaagacccccgtccacagctgggaggacatcccgtacctcggcaagcgcgaggacctgtggtgcgggtccctgatcggcctcagctcccgggccacctgggccaagaacatccacacggccatcacccaggtgcgcaacctgatcggcaaggaggagtacgtggactacatgcccgtcatgaagcggtacagcgcgccctccgagagcgagggggtgctgtga

SEQ ID NO: 10502 - RNA, 9867 nt, synthetic construct
  misc_feature 1..9867: note = derived and/or modified CDS sequence (opt1) from DENV-4__JQ915090__SS-prME
  source 1..9867: mol_type = other RNA
agcaccatgaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcatcgtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcgccaagaccacggccaaggaggtggccctgctgcggacctactgcatcgaggcgtccatcagcaacatcaccaccgccacgcgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcctgtgctccggcaagatcaccgggaacctcgtccagatcgagaacctggagtacacggtggtggtcaccgtgcacaacggcgacacccacgccgtcggcaacgacaccagcaaccacggggtgacggccaccatcacgccccggtcccccagcgtggaggtcaagctgccggactacggcgagctcaccctggactgcgagccccggtccgggatcgacttcaacgagatgatcctgatgaagatgaagaagaagacgtggctcgtgcacaagcagtggttcctggacctgcccctcccctggaccgcgggcgccgacaccagcgaggtgcactggaactacaaggagcgcatggtcaccttcaaggtgccgcacgccaagcggcaggacgtgaccgtcctggggtcccaggagggcgccatgcacagcgccctggcgggcgccacggaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacccagcacgggaccacggtcgtgaaggtgaagtacgagggcgccggggcgccctgcaagatccccatcgagatccgggacgtcaacaaggagaaggtggtgggccgcatcatcagctccacccccttcgccgagaacaccaacagcgtcatcaacatcgagctggagccgcccttcggggactcctacatcgtgatcggcgtgggcgacagcgccctcaccctgcactggttccggaaggggtccagcatcggcaagatgttcgagtccacgtaccgcggggccaagcggatggcgatcctgggcgagaccgcctgggacttcgggagcgtcggcggcctcttcacctccctggggaaggccgtgcaccaggtgttcggcagcgtctacaccacgatgttcgggggcgtgtcctggatgatccgcatcctgatcgggttcctcgtgctgtggatcggcaccaacagccggaacacctccatggccatgacctgcatcgccgtcggcgggatcacgctgttcctgggcttcaccgtgcaggcggacatggggtgcgtggtcagctggaacggcaaggagctcaagtgcgggtccggcatcttcgtggtggacaacgtccacacctggaccgagcagtacaagttccagcccgagagccccgcccgcctggccagcgccatcctgaacgcccacaaggacggcgtgtgcgggatccggtccacgacccgcctcgagaacgtgatgtggaagcagatcaccaacgagctgaactacgtcctgtgggagggcgggcacgacctcaccgtggtggcgggcgacgtcaagggcgtgctgacgaaggggaagcgggccctgaccccgcccgtgaacgacctcaagtacagctggaagacctggggcaaggccaagatcttcacccccgaggcccgcaactccacgttcctgatcgacgggcccgacaccagcgagtgcccgaacgagcggcgcgcctggaacttcttcgaggtcgaggactacggcttcgggatgttcaccaccaacatctggatgaagttccgggagggctccagcgaggtgtgcgaccaccgcctgatgtccgcggccatcaaggaccagaaggccgtgcacgccgacatgggctactggatcgagagctccaagaaccagacgtggcagatcgagaaggcgagcctcatcgaggtcaagacctgcctgtggcccaagacccacaccctgtggtccaacggggtgctcgagagccagatgctgatcccccggtcctacgccggcccgttcagccagcacaactaccgccaggggtacgccacgcagaccgccggcccctggcacctggggaagctcgagatcgacttcggcgagtgccccggcaccaccgtgaagatccaggaggactgcgaccaccgggggccctccctgcgcaccacgaccgccagcggcaagctggtcacccagtggtgctgccgctcctgcaccatgccgcccctccggttcctgggggaggacggctgctggtacgggatggagatccgccccctgagcgagaaggaggagaacatggtgaagtcccaggtgacggcgggccagggcacctccgagaccttcagcatggggctcctgtgcctgaccctcttcgtcgaggagtgcctgcggcgccgggtgacgcgcaagcacatgatcctggtcgtggtgatcaccttctgcgccatcatcctcggcgggctgacctggatggacctgctccgggccctgatcatgctgggcgacaccatgtccggccgcatcgggggccagatccacctcgccatcatgacggtcttcaagatgagccccgggtacgtgctgggcgtgttcctgcggaagctcacctcccgcgagaccgccctgatggtcatcgggatggcgatgaccacggtgttcagcatcccgcacgacctgatggagctcatcgacggcatctccctgggcctgatcctcctgaagatcgtgacccacttcgacaacacccaggtcgggaccctggccctcagcctgacgttcatgcggtccaccacgcccctggtgatggcctggcgcaccatcatggccgtgttcttcgtcatcacgctcatccccctgtgccggaccagctgcctgcagaagcagtcccactgggtggagatgaccgccctcatcctgggcgcgcaggccctgcccgtgtacctcatgaccctgatgaagggggccagccgccggtcctggccgctgaacgagggcatcatggccgtcgggctcgtgagcctgctgggctccgcgctcctgaagaacgacgtgcccctggccggccccatggtcgccgggggcctcctgctggccgcctacgtgatgagcgggtccagcgcggacctctccctggagaaggccgccaacgtgcagtgggacgagatggccgacatcacgggcagcagccccatcatcgaggtcaagcaggacgaggacgggtccttcagcatccgcgacgtggaggagaccaacatgatcaccctgctcgtgaagctggccctgatcaccgtctccggcctctacccgctggcgatccccgtgacgatggccctgtggtacatctggcaggtcaagacccagcggagcggcgccctctgggacgtcccctcccccgccgccacccagaaggcgaccctgagcgagggggtgtaccgcatcatgcagcggggcctgttcgggaagacccaggtgggcgtcgggatccacatggagggcgtgttccacaccatgtggcacgtgacccgcggctccgtcatctgccacgagaccgggcggctcgagccgagctgggccgacgtgcgctccgacatgatcagctacggcgggggctggcgcctgggcgacaagtgggacaaggaggaggacgtgcaggtcctggccatcgagcccgggaagaacccccggcacgtgcagaccaagcccggcctcttcaagacgctgaccggggagatcggcgccgtgaccctggacttcaagccggggacctccggcagccccatcatcaacaagaagggcaaggtcatcgggctctacggcaacggggtggtgacgaagtccggcgactacgtcagcgccatcacccaggcggagcgcatcggggagcccgactacgaggtggacgaggacatcttccggaagaagcgcctgaccatcatggacctgcacccgggcgccggcaagaccaagcggatcctcccctccatcgtgcgcgaggccctgaagcggcgcctgcggacgctcatcctggcccccacccgcgtcgtggcggccgagatggaggaggccctgcgggggctgcccatccgctaccagaccccggccgtcaagagcgagcacaccggccgggagatcgtcgacctcatgtgccacgccacgttcaccacccgcctgctgtccagcacccgggtgcccaactacaacctcatcgtgatggacgaggcgcacttcacggacccctgctccgtcgccgcccgcgggtacatcagcacccgggtggagatgggcgaggccgccgcgatcttcatgaccgccacgcccccggggagcatcgaccccttcccccagtccaacagccccatcgaggacatcgagcgcgagatcccggagcggtcctggaacacgggcttcgactggatcaccgactaccagggcaagaccgtctggttcgtgcccagcatcaaggccgggaacgacatcgccaactgcctgcgcaagtccggcaagcgcgtgatccagctgagccggaagaccttcgacacggagtaccccaagaccaagctcaccgactgggacttcgtcgtgaccacggacatctccgagatgggggccaacttccgcgcgggccgggtgatcgacccccgccggtgcctgaagccggtcatcctgaccgacgggcccgagcgcgtgatcctcgccggccccatccccgtgaccccggccagcgccgcgcagcggcgcggccggatcgggcgcaaccccgcccaggaggacgaccagtacgtcttctccggcgaccccctgaagaacgacgaggaccacgcccactggaccgaggccaagatgctgctcgacaacatctacacgcccgaggggatcatcccgaccctgttcggccccgagcgggagaagacccaggccatcgacggcgagttccgcctgcgcggggagcagcgcaagaccttcgtggagctcatgcggcgcggcgacctgcccgtgtggctgagctacaaggtcgcgtccgccgggatcagctacaaggaccgggagtggtgcttcacgggcgagcgcaacaaccagatcctcgaggagaacatggaggtggagatctggacccgggagggggagaagaagaagctgcgccccaagtggctggacgcccgggtgtacgccgacccgatggccctcaaggacttcaaggagttcgcgtccggccgcaagagcaccaccctggacatcctgacggagatcgccaccctccccacctacctgtccagcaaggccaagctggccctcgacaacatcgtcatgctgcacaccaccgagaagggcgggcgcgcctaccagcacgcgctgaacgagctccccgagtccctggagacgctgatgctcgtggccctgctgggcgccatgaccgccgggatcttcctcttcttcatgcagggcaaggggatcggcaagctgagcatgggcctgatcgcgatcgccgtggcctccgggctcctgtgggtcgccgagatccagccgcagtggatcgccgcgagcatcatcctggagttcttcctcatggtgctgctgatccccgagcccgagaagcagcggacgccccaggacaaccagctcatctacgtgatcctgaccatcctgacgatcatcggcctcatcgccgccaacgagatggggctgatcgagaagaccaagaccgacttcggcttctaccaggtcaagaccgagacgaccatcctggacgtggacctccgcccggccagcgcctggaccctgtacgcggtggccaccacgatcctgacccccatgctccggcacaccatcgagaacatgtccgccaacctgagcctggccgccatcgcgaaccaggccgccgtcctcatggggctgggcaagggctggcccctgcaccgcatggacctcggggtgcccctgctggccatgggctgctactcccaggtgaacccgaccacgctcaccgccagcctggtcatgctgctcatccactacgcgatcatcgggcccggcctgcaggccaaggccacccgggaggcccagaagcgcaccgcggccggcatcatgaagaaccccacggtggacgggatcaccgtgatcgacctggagcccatctcctacgacccgaagttcgagaagcagctcggccaggtcatgctgctggtgctctgcgtggggcagctgctgctcatgcggaccacctgggccctgtgcgaggtcctgacgctcgccaccggccccatcatgaccctgtgggaggggaaccccggccgcttctggaacaccacgatcgccgtgagcaccgcgaacatcttccggggctcctacctggccggggccggcctcgccttcagcctgatcaagaacgcccagacgccccgccgggggaccggcacgaccggggagaccctgggcgagaagtggaagcgccagctcaactccctggaccggaaggagttcgaggagtacaagcgcagcggcatcctggaggtggaccggaccgaggcgaagtccgccctccgcgacgggagcaagatcaagcacgccgtctcccggggcagctccaagatccgctggatcgtggagcgggggatgatcaagccgaagggcaaggtggtcgacctggggtgcggccgcggcgggtggagctactacatggccacgctgaagaacgtgaccgaggtgaagggctacaccaagggcggccccgggcacgaggagcccatccccatggccacctacggctggaacctcgtcaagctgcactccggcgtggacgtgttctacaagccgaccgagcaggtcgacacgctgctctgcgacatcggggagagctccagcaaccccaccatcgaggagggccgcaccctgcggatcctgaagatggtggagccctggctcagctccaagcccgagttctgcatcaaggtgctgaacccgtacatgcccaccgtcatcgaggagctggagaagctccagcgccggcacgggggcagcctggtgcgctgccccctgtcccggaacagcacgcacgagatgtactgggtgtccggcgcgagcgggaacatcgtctccagcgtgaacaccatctccaagatgctgctcaaccgcttcaccacccggcaccgcaagcccacgtacgagaaggacgtcgacctgggcgccgggacccggagcgtgtccaccgagaccgagaagccggacatgacgatcatcggccgccggctgcagcgcctccaggaggagcacaaggagacctggcactacgaccaggagaacccctaccggacctgggcctaccacgggagctacgaggccccctccaccggcagcgcgtccagcatggtgaacggcgtcgtgaagctgctgacgaagccgtgggacgtgatccccatggtcacccagctcgccatgaccgacaccacgcccttcgggcagcagcgcgtgttcaaggagaaggtggacacccggacgccccagccgaagctgggcacccgcatgatcatgacgaccaccgccaactggctgtgggccctcctggggaagaagaagtccccgcggctgtgcacccgcgaggagttcatcagcaaggtccggagcaacgccgcgatcggcgccgtgttccaggaggagcaggggtggacgagcgccatcgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgcgaaggggagccgggccatctggtacatgtggctcggcgcccgcttcctggagttcgaggccctggggttcctcaacgaggaccactggttctcccgggagaacagctggtccggcgtggagggcgaggggctgcaccgcctgggctacatcctcgaggacatcgacaagaaggacggggacctgatctacgccgacgacaccgcgggctgggacacccggatcaccgaggacgacctgctcaacgaggagctgatcacggagcagatggcgccccaccacaagaccctggccaaggccatcttcaagctcacctaccagaacaaggtcgtgaaggtgctgcgccccacccccaagggcgcggtcatggacatcatcagccggaaggaccagcgcgggtccggccaggtggggacgtacggcctgaacaccttcaccaacatggaggtgcagctcatccggcagatggaggccgagggggtcatcacccaggacgacatgcagaaccccaagggcctgaaggagcgcgtggagaagtggctgaaggagtgcggcgtggaccggctcaagcgcatggccatcagcggggacgactgcgtcgtgaagcccctggacgagcggttctccaccagcctcctgttcctgaacgacatgggcaaggtgcgcaaggacgtcccccagtgggagccgtccaaggggtggaagaactggcaggaggtgcccttctgcagccaccacttccacaagatcttcatgaaggacggccggtccctggtggtcccctgccgcaaccaggacgagctcatcgggcgggcccgcatcagccagggcgccggctggtccctgcgggagacggcgtgcctggggaaggcctacgcccagatgtggagcctcatgtacttccaccgccgcgacctgcggctggcctccatggccatctgcagcgcggtgcccaccgagtggttcccgaccagccgcaccacgtggtccatccacgcccagcaccagtggatgaccaccgaggacatgctcaaggtgtggaaccgggtctggatcgaggacaaccccaacatgaccgacaagacgcccgtgcacagctgggaggacatcccctacctgggcaagcgcgaggacctgtggtgcgggtccctcatcggcctgagctcccgggccacctgggccaagaacatccacaccgccatcacccaggtgcgcaacctgatcgggaaggaggagtacgtcgactacatgccggtgatgaagcggtacagctcccccagcgagtccgagggcgtgctctga

SEQ ID NO: 10503 - RNA, 9867 nt, synthetic construct
  misc_feature 1..9867: note = derived and/or modified CDS sequence (opt1) from DENV-4__KJ160504__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacccccctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggccgacatggggtgcgtggtgtcctggagcggccgcgagctcaagtgcgggagcggcatcttcgtcgtggacaacgtgcacacctggaccgagcagtacaagttccagcccgagtcccccgcgcggctggccagcgccatcctgaacgcccacaaggacggcgtctgcgggatccgctccaccacgcggctcgagaacgtgatgtggaagcagatcaccaacgagctgaactacgtgctgtgggagggcgggcacgacctcaccgtcgtggccggcgacgtgaagggcgtcctgaccaaggggaagcgcgcgctgacgccgcccgtgagcgacctcaagtactcctggaagacctggggcaaggccaagatcttcacccccgaggcccggaacagcaccttcctgatcgacgggcccgacacgtccgagtgcccgaacgagcgccgggcctggaacagcctggaggtggaggactacggcttcgggatgttcaccaccaacatctggatgaagttccgcgagggctccagcgaggtctgcgaccaccggctcatgtccgccgcgatcaaggaccagaaggccgtgcacgccgacatgggctactggatcgagagctccaagaaccagacctggcagatcgagaaggccagcctgatcgaggtgaagacgtgcctgtggcccaagacccacaccctctggtccaacggggtcctggagagccagatgctgatccccaagtcctacgcgggcccgttcagccagcacaactaccgccaggggtacgccacccagaccgtgggcccctggcacctcgggaagctggagatcgacttcggcgagtgccccggcacgaccgtgaccatccaggaggactgcgaccaccgggggcccagcctgcgcaccacgaccgcctccggcaagctcgtcacccagtggtgctgccgcagctgcaccatgccgcccctgcggttcctgggggaggacggctgctggtacgggatggagatccgccccctctccgagaaggaggagaacatggtgaagagccaggtcacggccggccagggcacctccgagaccttcagcatggggctgctgtgcctcaccctgttcgtggaggagtgcctgcggcgccgggtgacgcgcaagcacatgatcctcgtcgtggtgatcaccctgtgcgccatcatcctgggcgggctcacctggatggacctgctgcgggcgctcatcatgctgggcgacaccatgtccggccgcatcgggggccagatccacctggccatcatggccgtcttcaagatgagccccgggtacgtgctcggcgtgttcctgcggaagctgacgtcccgcgagaccgccctcatggtcatcgggatggccatgaccaccgtgctgagcatcccgcacgacctgatggagctcatcgacggcatctccctgggcctgatcctcctgaagatcgtgacgcagttcgacaacacccaggtcgggaccctggcgctcagcctgaccttcatccggtccacgatgcccctggtgatggcctggcgcaccatcatggccgtgctcttcgtcgtgaccctgatccccctgtgccggaccagctgcctccagaagcagtcccactgggtggagatcacggccctgatcctgggcgcccaggcgctccccgtctacctgatgaccctgatgaagggggccagccgccggtcctggccgctcaacgagggcatcatggccgtggggctggtgagcctgctcggctccgccctgctgaagaacgacgtccccctcgcgggccccatggtggccgggggcctgctgctcgccgcctacgtgatgagcgggagctccgccgacctgagcctggagaaggcggccaacgtccagtgggacgagatggccgacatcaccggctccagccccatcatcgaggtgaagcaggacgaggacgggtccttcagcatccgcgacgtggaggagaccaacatgatcacgctcctggtcaagctggccctcatcaccgtgtccggcctgtacccgctggccatccccatcaccatgaccctctggtacatgtggcaggtgaagacgcagcggagcggcgcgctgtgggacgtcccctcccccgccgccacccagaaggccgccctgagcgagggggtgtaccgcatcatgcagcggggcctcttcgggaagacccaggtgggcgtcgggatccacatggagggcgtgttccacaccatgtggcacgtgacccgcggctccgtcatctgccacgagacggggcggctggagccgagctgggcggacgtgcgcaacgacatgatctcctacggcgggggctggcgcctgggcgacaagtgggacaaggaggaggacgtgcaggtcctcgccatcgagcccgggaagaaccccaagcacgtgcagaccaagcccggcctgttcaagaccctgaccggggagatcggcgccgtgacgctcgacttcaagccggggaccagcggctcccccatcatcaaccggaagggcaaggtcatcgggctgtacggcaacggggtggtgaccaagagcggcgactacgtctccgccatcacccaggccgagcgcatcggggagcccgactacgaggtggacgaggacatcttccggaagaagcgcctgacgatcatggacctccacccgggcgcgggcaagaccaagcggatcctgcccagcatcgtgcgcgaggccctgaagcggcgcctgcggaccctcatcctggcccccacccgcgtcgtggccgcggagatggaggaggccctgcgggggctccccatccgctaccagacgccggccgtgaagtccgagcacaccggccgggagatcgtcgacctgatgtgccacgccaccttcaccacgcgcctgctcagcagcacccgggtgcccaactacaacctgatcgtcatggacgaggcccacttcaccgacccctccagcgtggcggcccgcgggtacatctccacccgggtggagatgggcgaggccgccgccatcttcatgacggcgacccccccgggggccaccgaccccttcccccagagcaactcccccatcgaggacatcgagcgcgagatcccggagcggagctggaacaccggcttcgactggatcacggactaccagggcaagaccgtctggttcgtgccctccatcaaggccgggaacgacatcgccaactgcctgcgcaagagcggcaagaaggtgatccagctctcccgcaagaccttcgggaccgagtaccccaagacgaagctgaccgactgggacttcgtcgtgaccaccgacatcagcgagatgggcgccaacttccgggcggggcgcgtgatcgacccccggcgctgcctgaagccggtcatcctcacggacggccccgagcgggtgatcctggccggccccatccccgtgaccccggcctccgccgcgcagcgccgggggcgcgtcggccggaaccccgcccaggaggacgaccagtacgtgttcagcggggaccccctgaagaacgacgaggaccacgcccactggaccgaggccaagatgctcctggacaacatctacacccccgagggcatcatcccgacgctgttcggccccgagcgcgagaagacccaggccatcgacggggagttccggctccgcggcgagcagcggaagaccttcgtggagctgatgcgccggggggacctgcccgtctggctctcctacaaggtggcgagcgccggcatctcctacaaggaccgcgagtggtgcttcaccggggagcggaacaaccagatcctggaggagaacatggaggtggagatctggacgcgcgagggcgagaagaagaagctgcggccccgctggctcgacgcccgggtctacgccgacccgatggccctgaaggacttcaaggagttcgcgagcggccgcaagtccatcaccctggacatcctcaccgagatcgccagcctgcccgcctacctgtccagccgcgccaagctcgccctggacaacatcgtgatgctgcacaccaccgagcgggggggccgcgcgtaccagcacgccctcaacgagctgcccgagagcctggagacgctcatgctggtggccctgctcggggccatgaccgcgggcatcttcctgttcttcatgcaggggaagggcatcggcaagctgtccatggggctcatcaccatcgccgtcgccagcggcctgctgtggatcgccgagatccagccgcagtggatcgccgcgtccatcatcctcgagttcttcctgatggtgctgctcatccccgagcccgagaagcagcggaccccccaggacaaccagctgatctacgtgatcctgacggtcctcaccatcatcgggctgatcgccgccaacgagatgggcctgatcgagaagaccaagaccgacttcgggttctaccaggtgaagacggagaccaccatcctcgacgtggacctgcgcccggccagcgcctggaccctgtacgcggtcgccacgaccgtgctcacccccatgctgcggcacaccatcgagaacacgtccgccaacctgagcctcgccgccatcgcgaaccaggccgccgtgctgatgggcctgggcaaggggtggcccctccaccgcatggacctgggcgtccccctgctcgccatggggtgctactcccaggtgaacccgaccaccctgaccgccagcctggtgatgctcttcgtccactacgcgatcatcggccccggcctgcaggccaaggccacgcgggaggcccagaagcgcaccgcggccgggatcatgaagaaccccaccgtggacggcatcaccgtgatcgacctggagcccatctcctacgacccgaagttcgagaagcagctcgggcaggtcatgctgctggtgctctgcgccggccagctgctgctcatgcggacgacctgggccttctgcgaggtgctgaccctggccaccgggcccatcctcacgctgtgggagggcaaccccggccgcttctggaacaccaccatcgcggtcagcaccgccaacatcttccgggggtcctacctggccggcgccgggctcgccttcagcctgatcaagaacgcgcagacgccccgccggggcaccgggaccaccggcgagacgctgggcgagaagtggaagcgccagctcaactccctggaccggaaggagttcgaggagtacaagcgcagcgggatcctggaggtggaccggaccgaggccaagtccgccctcaaggacggcagcaagatcaagcacgccgtgtcccgcgggagctccaagatccggtggatcgtcgagcgcggcatggtgaagccgaaggggaaggtggtcgacctgggctgcggccgcgggggctggagctactacatggccaccctgaagaacgtgaccgaggtgaaggggtacaccaagggcgggcccggccacgaggagcccatccccatggcgacgtacggctggaacctcgtcaagctgcacagcggggtggacgtgttctacaagccgaccgagcaggtcgacaccctgctctgcgacatcggcgagtccagctccaaccccaccatcgaggaggggcggacgctgcgcgtgctgaagatggtcgagccctggctcagctccaagcccgagttctgcatcaaggtgctgaacccgtacatgcccaccgtgatcgaggagctggagaagctgcagcggaagcacggcggcaacctcgtccgctgccccctgagccggaactccacccacgagatgtactgggtgagcggggcctccggcaacatcgtgagctccgtcaacaccacgagcaagatgctgctcaaccgcttcaccacccggcaccgcaagcccacctacgagaaggacgtggacctgggggccggcacgcggtccgtgagcaccgagaccgagaagccggacatgaccatcatcgggcgccggctgcagcgcctccaggaggagcacaaggagacgtggcactacgaccaggagaacccctaccggacctgggcctaccacggctcctacgaggcgcccagcaccggctccgccagctccatggtcaacggggtggtgaagctgctgaccaagccgtgggacgtcatccccatggtgacgcagctcgccatgaccgacaccacccccttcggccagcagcgcgtgttcaaggagaaggtcgacacgcggaccccccagccgaagcccgggacccgcatggtgatgaccacgaccgccaactggctgtgggccctgctcggcaagaagaagaacccccggctgtgcacccgcgaggagttcatcagcaaggtgcggagcaacgcggccatcggggccgtcttccaggaggagcagggctggacctccgccagcgaggccgtgaacgactcccgcttctgggagctggtggacaaggagcgggcgctccaccaggagggcaagtgcgagagctgcgtctacaacatgatggggaagcgcgagaagaagctgggcgagttcgggcgcgccaagggctcccgggccatctggtacatgtggctgggggcccgcttcctcgagttcgaggccctgggcttcctgaacgaggaccactggttcggccgggagaacagctggtccggggtggagggcgaggggctccaccgcctgggctacatcctggaggagatcgacaagaaggacggcgacctcatgtacgcggacgacacggccgggtgggacacccggatcaccgaggacgacctgcagaacgaggagctgatcaccgagcagatggccccccaccacaagatcctcgccaaggcgatcttcaagctgacgtaccagaacaaggtggtcaaggtgctgcgcccgaccccccggggcgccgtgatggacatcatcagccgcaaggaccagcgggggtccggccaggtcgggacctacggcctcaacaccttcaccaacatggaggtgcagctgatccgccagatggaggccgagggcgtgatcacgcaggacgacatgcagaaccccaaggggctgaaggagcgggtcgagaagtggctccgcgagtgcggcgtggaccggctgaagcgcatggccatcagcggggacgactgcgtggtcaagcccctggacgagcggttcggcacctccctcctgttcctgaacgacatggggaaggtgcgcaaggacatcccgcagtgggagcccagcaagggctggaagaactggcaggaggtgcccttctgctcccaccacttccacaagatcttcatgaaggacggccggagcctcgtcgtgccctgccgcaaccaggacgagctgatcgggcgggcccgcatctcccagggcgcggggtggagcctgcgcgagaccgcctgcctcggcaaggcctacgcccagatgtggtccctgatgtacttccaccggcgcgacctgcggctcgccagcatggcgatctgcagcgccgtgccgaccgagtggttccccacgtcccgcaccacctggagcatccacgcccaccaccagtggatgaccacggaggacatgctgaaggtctggaaccgggtgtggatcgaggacaaccccaacatgaccgacaagacccccgtgcactcctgggaggacatcccgtacctggggaagcgcgaggacctctggtgcggcagcctgatcggcctgtccagccgggccacctgggccaagaacatccacacggcgatcacccaggtccgcaacctcatcgggaaggaggagtacgtggactacatgcccgtgatgaagcggtactccgcccccagcgagtccgagggcgtcctgtga

SEQ ID NO: 10504 - RNA, 9867 nt, synthetic construct
  misc_feature 1..9867: note = derived and/or modified CDS sequence (opt1) from DENV-4__GU289913__SS-prME
  source 1..9867: mol_type = other RNA
agcaccatcaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccatgatcacgccccggagcccctccgtggaggtcaagctgccggactacggcgagctgacgctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcaccttcaaggtgccgcacgccaagcggcaggacgtgacggtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacccagcacgggacgaccgtcgtgaaggtgaagtacgagggcgccggggccccctgcaaggtccccatcgagatccgggacgtgaacaaggagaaggtggtcggccgcatcatctccagcacgcccctggcggagaacaccaactccgtgacgaacatcgagctggagccgcccttcggggacagctacatcgtgatcggcgtcggcaactccgccctcaccctgcactggttccggaaggggagctccatcggcaagatgttcgagagcacctaccgcggggccaagcggatggccatcctgggcgagaccgcgtgggacttcgggtccgtgggcggcctcttcacgagcctggggaaggccgtgcaccaggtcttcggctccgtgtacaccaccatgttcgggggcgtgagctggatgatccgcatcctgatcgggttcctcgtcctgtggatcggcaccaactcccggaacacgagcatggccatgacctgcatcgccgtgggcgggatcaccctgttcctgggcttcaccgtgcaggccgacatggggtgcgtcgtgtcctggagcggcaaggagctcaagtgcgggagcggcatcttcgtggtcgacaacgtgcacacgtggaccgagcagtacaagttccagcccgagtcccccgcgcgcctggccagcgccatcctgaacgcccacaaggacggcgtgtgcgggatccggtccaccacccgcctcgagaacgtcatgtggaagcagatcacgaacgagctgaactacgtgctgtgggagggcgggcacgacctcaccgtggtcgccggcgacgtgaagggcgtgctgaccaaggggaagcgggcgctgaccccgcccgtcagcgacctcaagtactcctggaagacgtggggcaaggccaagatcttcacccccgaggcccgcaacagcaccttcctgatcgacgggcccgacacctccgagtgcccgaacgagcggcgcgcctggaacagcctggaggtggaggactacggcttcgggatgttcacgaccaacatctggatgaagttccgggagggctccagcgaggtgtgcgaccaccgcctcatgtccgccgcgatcaaggaccagaaggccgtccacgccgacatgggctactggatcgagagctccaagaaccagacctggcagatcgagaaggccagcctgatcgaggtgaagacctgcctgtggcccaagacgcacaccctctggtccaacggggtgctggagagccagatgctgatccccaagtcctacgcgggcccgttcagccagcacaactaccggcaggggtacgccacccagaccgtcggcccctggcacctcgggaagctggagatcgacttcggcgagtgccccggcaccacggtgaccatccaggaggactgcgaccaccgcgggcccagcctgcggaccaccacggcctccggcaagctcgtgacccagtggtgctgccgcagctgcaccatgccgcccctgcgcttcctgggggaggacggctgctggtacgggatggagatccggcccctctccgagaaggaggagaacatggtcaagagccaggtgaccgccggccagggcacgtccgagaccttcagcatggggctgctgtgcctcaccctgttcgtcgaggagtgcctgcgccggcgcgtgacccggaagcacatgatcctcgtggtcgtgatcacgctgtgcgccatcatcctgggcgggctcacctggatggacctgctgcgcgcgctcatcatgctgggcgacaccatgtccggccggatcgggggccagatccacctggccatcatggccgtgttcaagatgagccccgggtacgtcctcggcgtgttcctgcgcaagctgacctcccgggagacggccctcatggtgatcgggatggccatgaccaccgtcctgagcatcccgcacgacctgatggagctcatcgacggcatctccctgggcctgatcctcctgaagatcgtgacccagttcgacaacacccaggtggggaccctggcgctcagcctgaccttcatccgctccaccatgcccctggtcatggcctggcggacgatcatggccgtcctcttcgtggtcaccctgatccccctgtgccgcaccagctgcctccagaagcagtcccactgggtggagatcaccgccctgatcctgggcgcccaggcgctccccgtgtacctgatgacgctgatgaagggggccagccggcgctcctggccgctcaacgagggcatcatggccgtcgggctggtgagcctgctcggctccgccctgctgaagaacgacgtgcccctcgcgggccccatggtcgccgggggcctgctgctcgccgcctacgtgatgagcgggagctccgccgacctgagcctggagaaggcggccaacgtgcagtgggacgagatggccgacatcaccggctccagccccatcatcgaggtcaagcaggacgaggacgggtccttcagcatccgggacgtggaggagaccaacatgatcaccctcctggtgaagctggccctcatcacggtctccggcctgtacccgctggccatccccgtgaccatgaccctctggtacatgtggcaggtcaagacccagcgcagcggcgcgctgtgggacgtcccctcccccgccgccacgcagaaggccgccctgagcgagggggtgtaccggatcatgcagcgcggcctcttcgggaagacccaggtgggcgtcgggatccacatggagggcgtgttccacaccatgtggcacgtgacccggggctccgtcatctgccacgagaccgggcgcctggagccgagctgggcggacgtgcggaacgacatgatctcctacggcgggggctggcgcctgggcgacaagtgggacaaggaggaggacgtgcaggtcctcgccatcgagcccgggaagaaccccaagcacgtgcagacgaagcccggcctgttcaagaccctgaccggggagatcggcgccgtgaccctcgacttcaagccggggacgagcggctcccccatcatcaaccgcaagggcaaggtcatcgggctgtacggcaacggggtggtgaccaagagcggcgactacgtctccgccatcacccaggccgagcggatcggggagcccgactacgaggtggacgaggacatcttccgcaagaagcggctgaccatcatggacctccacccgggcgcgggcaagacgaagcgcatcctgcccagcatcgtgcgggaggccctgaagcgccggctgcgcaccctcatcctggcccccacccgggtcgtggccgcggagatggaggaggccctgcgcgggctccccatccggtaccagaccccggccgtgaagtccgagcacacgggccgcgagatcgtcgacctgatgtgccacgccaccttcaccacccggctgctcagcagcacgcgcgtgcccaactacaacctgatcgtcatggacgaggcccacttcaccgacccctccagcgtggcggcccgggggtacatctccacccgcgtggagatgggcgaggccgccgccatcttcatgaccgcgacgcccccgggggccaccgaccccttcccccagagcaactcccccatcgaggacatcgagcgggagatcccggagcgcagctggaacaccggcttcgactggatcaccgactaccagggcaagacggtctggttcgtgccctccatcaaggccgggaacgacatcgccaactgcctgcgcaagagcggcaagaaggtgatccagctctcccgcaagaccttcgacaccgagtaccccaagaccaagctgacggactgggacttcgtcgtgaccaccgacatcagcgagatgggggccaacttccgcgcgggccgggtgatcgacccccgccggtgcctgaagccggtcatcctcaccgacgggcccgagcgcgtgatcctggccggccccatccccgtgacgccggcctccgccgcgcagcggcgcggccggatcgggcgcaaccccgcccaggaggacgaccagtacgtcttcagcggcgaccccctgaagaacgacgaggaccacgcccactggaccgaggccaagatgctcctggacaacatctacacccccgaggggatcatcccgaccctgttcggccccgagcgggagaagacgcaggccatcgacggcgagttccgcctccgcggggagcagcgcaagaccttcgtggagctgatgcggcgcggcgacctgcccgtgtggctctcctacaaggtcgcgagcgccgggatctcctacaaggaccgggagtggtgcttcaccggcgagcgcaacaaccagatcctggaggagaacatggaggtggagatctggacccgggagggggagaagaagaagctgcgcccccggtggctcgacgcccgcgtgtacgccgacccgatggccctgaaggacttcaaggagttcgcgagcggccggaagtccatcacgctggacatcctcaccgagatcgccagcctgcccacctacctgtccagccgcgccaagctcgccctggacaacatcgtcatgctgcacaccaccgagcgcggcgggcgggcctaccagcacgcgctcaacgagctgcccgagagcctggagacgctcatgctggtggccctgctcggcgccatgaccgccgggatcttcctgttcttcatgcagggcaaggggatcggcaagctgtccatgggcctcatcaccatcgcggtggccagcgggctgctgtgggtcgccgagatccagccgcagtggatcgccgcctccatcatcctcgagttcttcctgatggtgctgctcatccccgagcccgagaagcagcgcacgccccaggacaaccagctgatctacgtgatcctgacgatcctcaccatcatcggcctgatcgcggccaacgagatggggctgatcgagaagaccaagaccgacttcggcttctaccaggtcaagacggagaccaccatcctcgacgtggacctgcggccggccagcgcctggaccctgtacgccgtggcgacgaccatcctcacccccatgctgcgccacaccatcgagaacacgtccgccaacctgagcctcgccgccatcgccaaccaggcggccgtcctgatggggctgggcaagggctggcccctccaccggatggacctgggggtgcccctgctcgccatgggctgctactcccaggtgaacccgaccaccctgaccgccagcctggtcatgctctccgtgcactacgccatcatcgggcccggcctgcaggcgaaggccacgcgcgaggcccagaagcggaccgccgcgggcatcatgaagaaccccaccgtggacgggatcaccgtcatcgacctggagcccatcagctacgacccgaagttcgagaagcagctcggccaggtgatgctgctggtgctctgcgccgggcagctgctgctcatgcgcacgacctgggccttctgcgaggtcctgaccctggccaccggccccatcctcacgctgtgggaggggaaccccggccggttctggaacaccaccatcgccgtgtccaccgcgaacatcttccgcggcagctacctggccggggccggcctcgccttctccctgatcaagaacgcccagacgccccggcgcgggaccggcaccaccggggagacgctgggcgagaagtggaagcggcagctcaacagcctggaccgcaaggagttcgaggagtacaagcggtccggcatcctggaggtggaccgcaccgaggccaagagcgccctcaaggacgggtccaagatcaagcacgccgtcagccggggctccagcaagatccgctggatcgtggagcgggggatggtgaagccgaagggcaaggtcgtggacctggggtgcggccgcggcgggtggagctactacatggccaccctgaagaacgtgaccgaggtcaagggctacaccaagggcgggcccgggcacgaggagcccatccccatggccacgtacggctggaacctcgtgaagctgcactccggcgtggacgtcttctacaagccgaccgagcaggtcgacaccctgctctgcgacatcggggagagctccagcaaccccaccatcgaggagggccgcacgctgcgggtgctgaagatggtcgagccctggctctccagcaagcccgagttctgcatcaaggtgctgaacccgtacatgcccaccgtcatcgaggagctggagaagctgcagcgcaagcacgggggcaacctcgtgcggtgccccctgtcccgcaacagcacccacgagatgtactgggtgtccggcgcgagcgggaacatcgtctccagcgtgaacaccacgtccaagatgctgctcaaccggttcaccacccgccaccggaagcccacctacgagaaggacgtggacctgggcgccgggacgcgcagcgtctccaccgagaccgagaagccggacatgaccatcatcggccggcgcctgcagcggctccaggaggagcacaaggagacgtggcactacgaccaggagaacccctaccgcacctgggcctaccacgggagctacgaggccccctccaccggcagcgcgtccagcatggtgaacggcgtggtcaagctgctgaccaagccgtgggacgtgatccccatggtgacgcagctcgccatgaccgacaccacccccttcgggcagcagcgggtcttcaaggagaaggtggacacgcgcacgccccagccgaagcccggcacccggatggtgatgaccacgaccgccaactggctgtgggccctgctcgggaagaagaagaacccccgcctgtgcacccgggaggagttcatcagcaaggtccgctccaacgccgcgatcggcgccgtgttccaggaggagcaggggtggaccagcgcctccgaggccgtgaacgacagccggttctgggagctggtcgacaaggagcgcgccctccaccaggagggcaagtgcgagtcctgcgtgtacaacatgatgggcaagcgggagaagaagctgggggagttcggccgcgcgaaggggagccgcgccatctggtacatgtggctgggcgcccggttcctcgagttcgaggccctggggttcctgaacgaggaccactggttcggccgcgagaactcctggagcggcgtggagggggagggcctccaccggctggggtacatcctggaggagatcgacaagaaggacggcgacctcatgtacgccgacgacacggcgggctgggacacccgcatcaccgaggacgacctgcagaacgaggagctgatcaccgagcagatggcgccccaccacaagatcctcgccaaggccatcttcaagctgacgtaccagaacaaggtcgtgaaggtgctgcggccgacgccccgcggggcggtcatggacatcatctcccggaaggaccagcggggcagcggccaggtgggcacctacgggctcaacaccttcaccaacatggaggtgcagctgatccggcagatggaggccgagggcgtcatcacgcaggacgacatgcagaaccccaagggcctgaaggagcgcgtggagaagtggctcaaggagtgcggggtggaccggctgaagcgcatggccatctccggcgacgactgcgtcgtgaagcccctggacgagcggttcgggaccagcctcctgttcctgaacgacatgggcaaggtgcgcaaggacatcccgcagtgggagccctccaaggggtggaagaactggcaggaggtccccttctgcagccaccacttccacaagatcttcatgaaggacggccggtccctcgtggtgccctgccgcaaccaggacgagctgatcggccgggcccgcatcagccagggggccggctggtccctgcgggagaccgcgtgcctcgggaaggcctacgcccagatgtggagcctgatgtacttccaccgccgcgacctgcggctcgccagcatggccatctgctccgcggtcccgaccgagtggttccccacgagccgcaccacctggtccatccacgcccaccaccagtggatgaccacggaggacatgctgaaggtgtggaaccgggtgtggatcgaggacaaccccaacatgaccgacaagacccccgtccacagctgggaggacatcccgtacctgggcaagcgcgaggacctctggtgcgggtccctgatcggcctgagctcccgggccacctgggccaagaacatccacacggccatcacccaggtgcgcaacctcatcggcaaggaggagtacgtggactacatgcccgtcatgaagcggtacagcgcgccctccgagagcgagggggtgctgtga

SEQ ID NO: 10505 - RNA, 9867 nt, synthetic construct
  misc_feature 1..9867: note = derived and/or modified CDS sequence (opt1) from DENV-4__KJ579243__SS-prME
  source 1..9867: mol_type = other RNA
agcaccatcaccctgctctgcctgatccccacggtgatggccttccacctgtccacccgcgacggcgagcccctcatgatcgtggccaagcacgagcgggggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggtgcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcggcctgaagtactcctggaagacctgggggaaggccaagatcttcacccccgaggcccggaacagcacgttcctgatcgacggccccgacacctccgagtgcccgaacgagcgccgggcctggaacagcttcgaggtggaggactacgggttcggcatgttcaccaccaacatctggatgaagttccgcgagggctccagcgaggtgtgcgaccaccggctcatgtccgcggccatcaaggaccagaaggccgtccacgccgacatggggtactggatcgagagctccaagaaccagacgtggcagatcgagcgcgcgagcctgatcgaggtgaagacctgcctgtggcccaagacccacaccctctggtccaacggcgtgctggagagccagatgctgatccccaagtcctacgccgggccgttcagccagcacaactaccggcagggctacgccacccagacggtcgggccctggcacctcggcaagctggagatcgacttcggcgagtgccccgggaccaccgtgaccatccaggagaactgcgaccaccgcggcccctccctgcgcacgaccaccgccagcgggaagctcgtgacccagtggtgctgccggagctgcacgatgccgcccctgcgcttcctgggcgaggacgggtgctggtacggcatggagatccggcccctctccgagaaggaggagaacatggtcaagagccaggtgaccgccggccaggggacctccgagaccttcagcatgggcctgctgtgcctcacgctgttcgtcgaggagtgcctgcgccggcgcgtgacccggaagcacatgatcctcgcggtggtcatcaccctgtgcgccatcatcctcggcgggctcacctggatggacctgctgcgcgccctcatcatcctgggggacacgatgtccgggcggatcggcgggcagacccacctggccatcatggccgtgttcaagatgagccccggctacgtgctcggggtcttcctgcgcaagctgacctcccgggagaccgcgctcatggtgatcggcatggccatgacgaccaccctgagcatcccgcacgacctgatggagctcatcgacggcatctccctggggctgatcctcctgaagatcgtgacccagttcgacaacacgcaggtcggcaccctggccctcagcctgaccttcatccgctccaccatgagcctggtgatggcctggcggacgatcatggccgtgctgttcgtcgtgaccctgatccccctgtgccgcacctcctgcctccagaagcagagccactgggtggagatcaccgcgctgatcctgggggcccaggccctccccgtctacctgatgacgctgatgaagggcgcctcccggcgcagctggcccctcaacgaggggatcatggcggtgggcctggtgtccctgctcggcagcgccctgctgaagaacgacgtcccgctcgccgggcccatggtggccggcgggctgctgctcgccgcgtacgtgatgtccggcagcagcgccgacctgtccctggagaaggccgccaacgtccagtgggacgagatggccgacatcaccgggagctcccccatcatcgaggtgaagcaggacgaggacggcagcttctccatccgggacgtggaggagaccaacatgatcaccctcctggtcaagctggcgctcatcacggtgagcggcctgtaccccctggccatcccgatcaccatgaccctctggtacatgtggcaggtcaagacccagcgctccggggccctgtgggacgtccccagccccgccgccacccagaaggcggccctgtccgagggcgtgtaccggatcatgcagcgcggcctcttcggcaagacccaggtgggggtcggcatccacatggagggcgtgttccacaccatgtggcacgtgacccgggggagcgtcatctgccacgagaccggccgcctggagccctcctgggccgacgtgcgcaacgacatgatcagctacgggggcggctggcggctgggggacaagtgggacaaggaggaggacgtgcaggtcctcgccatcgagccgggcaagaaccccaagcacgtgcagacgaagcccgggctgttcaagaccctgaccggcgagatcggggccgtgaccctcgacttcaagcccggcacgtccggcagcccgatcatcaaccgcaaggggaaggtcatcggcctgtacgggaacggcgtggtgaccaagtccggggactacgtcagcgcgatcacccaggccgagcggatcggcgagcccgactacgaggtggacgaggacatcttccgcaagaagcggctgaccatcatggacctccaccccggcgccgggaagacgaagcgcatcctgccgtccatcgtgcgggaggccctgaagcgccggctgcgcaccctcatcctggcgcccacccgggtcgtggccgccgagatggaggaggccctgcgcggcctccccatccggtaccagacccccgccgtcaagagcgagcacacggggcgcgagatcgtcgacctgatgtgccacgcgaccttcaccacccggctgctctccagcacgcgcgtgccgaactacaacctgatcgtgatggacgaggcccacttcaccgaccccagctccgtcgccgcccggggctacatcagcacccgcgtggagatgggggaggccgcggccatcttcatgaccgccacgccgcccggcgccaccgacccgttcccccagtccaacagccccatcgaggacatcgagcgggagatccccgagcgctcctggaacaccggcttcgactggatcaccgactaccaggggaagacggtctggttcgtgccgagcatcaaggccggcaacgacatcgcgaactgcctgcgcaagtccgggaagaaggtgatccagctcagccggaagaccttcgacaccgagtaccccaagaccaagctgacggactgggacttcgtcgtgaccaccgacatctccgagatgggcgccaacttccgcgccgggcgggtgatcgacccccgccggtgcctgaagcccgtcatcctcaccgacggcccggagcgcgtgatcctggccggccccatccccgtgacgcccgcgagcgccgcccagcggcgcgggcggatcggccgcaacccggcccaggaggacgaccagtacgtcttctccggggaccccctgaagaacgacgaggaccacgcccactggaccgaggcgaagatgctcctggacaacatctacacccccgagggcatcatccccaccctgttcggcccggagcgggagaagacgcaggccatcgacggggagttccgcctccggggcgagcagcgcaagaccttcgtggagctgatgcggcgcggggacctgcccgtgtggctcagctacaaggtcgcctccgccggcatcagctacaaggaccgggagtggtgcttcaccggggagcgcaacaaccagatcctggaggagaacatggaggtggagatctggacccgggagggcgagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcgcgggggccgcgcctaccagcacgccctcaacgagctgcccgagagcctggagacgctcatgctggtggccctgctcggggcgatgaccgccggcatcttcctgttcttcatgcaggggaagggcatcggcaagctgagcatggggctcatcaccatcgccgtggcctccggcctgctgtgggtcgccgagatccagccccagtggatcgcggccagcatcatcctcgagttcttcctgatggtgctgctcatcccggagcccgagaagcagcggacgccccaggacaaccagctgatctacgtgatcctgacgatcctcaccatcatcgggctgatcgccgccaacgagatgggcctgatcgagaagaccaagaccgacttcgggttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatgggcctgggcaaggggtggcccctccaccgcatggacctgggcgtgcccctgctcgccatggggtgctacagccaggtgaaccccaccaccctgaccgcgtccctggtcatgctcctggtgcactacgccatcatcggcccgggcctgcaggccaaggccacgcgggaggcgcagaagcgcaccgccgccgggatcatgaagaaccccaccgtggacggcatcaccgtcatcgacctcgagcccatcagctacgaccccaagttcgagaagcagctgggccaggtgatgctgctcgtgctgtgcgccggccagctgctcctgatgcggacgacctgggccttctgcgaggtcctgaccctcgcgaccgggccgatcctgacgctgtgggagggcaaccccggccgcttctggaacaccaccatcgccgtgtccaccgccaacatcttccgggggagctacctcgccggcgccgggctggcgttctccctgatcaagaacgcccagacgccccgccggggcaccgggaccgccggcgagaccctcggcgagaagtggaagcgccagctgaacagcctggaccggaaggagttcgaggagtacaagcgctccgggatcctcgaggtggaccggaccgaggccaagagcgccctgaaggacggctccaagatcaagcacgcggtcagccgcgggtccagcaagatccggtggatcgtggagcgcggcatggtgaagcccaaggggaaggtcgtggacctgggctgcggccgcgggggctggtcctactacatggccacgctcaagaacgtgaccgaggtcaaggggtacaccaagggcgggccgggccacgaggagcccatccccatggccacctacggctggaacctggtgaagctgcacagcggggtggacgtcttctacaagcccacggagcaggtcgacaccctcctgtgcgacatcggcgagagctccagcaacccgaccatcgaggaggggcggaccctgcgcgtgctcaagatggtcgagccctggctgtccagcaagcccgagttctgcatcaaggtgctgaacccctacatgccgacggtgatcgaggagctggagaagctccagcggaagcacggcggcaacctggtccgctgccccctgtcccggaacagcacccacgagatgtactgggtgtccggggccagcggcaacatcgtctccagcgtgaacaccacctccaagatgctcctgaaccgcttcacgacccggcaccgcaagcccacctacgagaaggacgtggacctgggggcgggcacccggagcgtctccacggagaccgagaagcccgacatgaccatcatcgggcgccggctccagcgcctgcaggaggagcacaaggagacctggcactacgaccaggagaacccgtaccggacgtgggcctaccacggcagctacgaggccccctccaccggcagcgcctccagcatggtgaacggggtggtcaagctgctcaccaagccctgggacgtgatcccgatggtgacccagctggccatgacggacaccacccccttcggccagcagcgcgtcttcaaggagaaggtggacacccggacgccccagcccaagccggggacccgcatggtgatgaccaccacggcgaactggctgtgggccctcctgggcaagaagaagaacccccggctgtgcacccgcgaggagttcatctccaaggtccggagcaacgccgccatcggggccgtgttccaggaggagcagggctggaccagcgcgtccgaggccgtgaacgacagccgcttctgggagctcgtcgacaaggagcgggccctgcaccaggagggcaagtgcgagtcctgcgtgtacaacatgatggggaagcgcgagaagaagctgggcgagttcgggcgcgccaagggcagccgggccatctggtacatgtggctcggggcgcgcttcctggagttcgaggccctgggcttcctcaacgaggaccactggttcggccgggagaactcctggagcggggtggagggcgaggggctgcaccgcctgggctacatcctcgaggagatcgacaagaaggacggcgacctgatgtacgccgacgacaccgccgggtgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggcgccgtcatggacatcatctcccgcaaggaccagcgggggagcggccaggtggggacgtacggcctgaacaccttcaccaacatggaggtgcagctgatccgccagatggaggccgagggcgtcatcacccaggacgacatgcagaaccccaaggggctcaaggagcgggtggagaagtggctgcgcgagtgcggcgtggaccggctgaagcgcatggcgatctccggggacgactgcgtcgtgaagcccctcgacgagcggttcggcacgagcctgctgttcctcaacgacatggggaaggtgcgcaaggacatcccccagtgggagccgtccaagggctggaagaactggcaggaggtccccttctgcagccaccacttccacaagatcttcatgaaggacggccggtccctggtggtgccctgccgcaaccaggacgagctgatcgggcgggcccgcatcagccagggcgccgggtggtccctccgcgagaccgcctgcctgggcaaggcctacgcgcagatgtggagcctgatgtacttccaccggcgcgacctccggctggcctccatggccatctgcagcgccgtccccaccgagtggttcccgaccagccgcacgacctggtccatccacgcccaccaccagtggatgaccaccgaggacatgctgaaggtgtggaaccgggtgtggatcgaggacaaccccaacatgatcgacaagacgcccgtccacagctgggaggacatcccctacctcgggaagcgcgaggacctgtggtgcggctccctgatcggcctcagctcccgggcgacctgggccaagaacatccacaccgccatcacccaggtgcgcaacctgatcgggaaggaggagtacgtggactacatgccggtcatgaagcggtacagcgccccctccgagagcgagggcgtgctgtga

SEQ ID NO: 10506 - RNA, 9867 nt, synthetic construct
  misc_feature 1..9867: note = derived and/or modified CDS sequence (opt1) from DENV-4__KJ579246__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatcctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacgtacgggctgaacaccttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggacgagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtccccaccgagtggttcccgaccagccgcacgacctggtccatccacgcccaccaccagtggatgaccaccgaggacatgctgaaggtgtggaaccgggtgtggatcgaggacaaccccaacatgatcgacaagacgcccatccacagctgggaggacatcccctacctcggcaagcgcgaggacctgtggtgcgggtccctgatcggcctcagctcccgggcgacctgggccaagaacatccacaccgccatcacccaggtccgcaacctgatcggcaaggaggagtacgtggactacatgccggtgatgaagcggtacagcgccccctccgagagcgagggggtcctgtga

SEQ ID NO: 10507 - RNA, 9867 nt, synthetic construct
  misc_feature 1..9867: note = derived and/or modified CDS sequence (opt1) from DENV-4__KJ579248__SS-prME
  source 1..9867: mol_type = other RNA
agcaccatcaccctgctctgcctgatccccaccgtgatggccttccacctgtccacccgggacggcgagcccctcatgatcgtggccaagcacgagcgggggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccgggtcggcgggcagacccacctggccatcatcgccgtgttcaagatgagccccgggtacgtcctcggggtgttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtcacccagttcgacaacacccaggtggggaccctggccctcagcctgaccttcatccgctccaccatgagcctggtgatggcctggcggacgatcatggccgtcctcttcgtggtgaccctgatccccctgtgccgcacctcctgcctccagaagcagagccactgggtcgagatcaccgcgctgatcctgggcgcccaggccctccccgtgtacctgatgacgctgatgaagggggcctcccggcgcagctggcccctcaacgagggcatcatggcggtggggctggtctccctgctcggcagcgccctgctgaagaacgacgtgccgctcgccggccccatggtggccgggggcctgctgctcgccgcgtacgtcatgtccgggagcagcgccgacctgtccctggagaaggccgccaacgtgcagtgggacgagatggccgacatcaccggcagctcccccatcatcgaggtgaagcaggacgaggacgggagcttctccatccgggacgtcgaggagaccaacatgatcaccctcctggtgaagctggcgctcatcacggtgagcggcctgtaccccctggccatcccgatcaccatgaccctctggtacatgtggcaggtcaagacccagcgctccggcgccctgtgggacgtgcccagccccgccgccacccagaaggcggccctgtccgagggggtgtaccggatcatgcagcgcggcctcttcgggaagacgcaggtcggcgtggggatccacatggagggcgtgttccacaccatgtggcacgtcacccggggcagcgtgatctgccacgagaccgggcgcctggagccctcctgggccgacgtgcgcaacgacatgatcagctacggcgggggctggcggctgggcgacaagtgggacaaggaggaggacgtccaggtgctcgccatcgagccggggaagaaccccaagcacgtgcagacgaagcccggcctgttcaagaccctgaccggggagatcggcgccgtcaccctcgacttcaagcccgggacgtccggcagcccgatcatcaaccgcaagggcaaggtgatcgggctgtacggcaacggggtggtcaccaagtccggcgactacgtgagcgcgatcacccaggccgagcggatcggggagcccgactacgaggtggacgaggacatcttccgcaagaagcggctgaccatcatggacctccaccccggcgccggcaagacgaagcgcatcctgccgtccatcgtccgggaggccctgaagcgccggctgcgcaccctcatcctggcgcccacccgggtggtggccgccgagatggaggaggccctgcgcgggctccccatccggtaccagacccccgccgtcaagagcgagcacacgggccgcgagatcgtggacctgatgtgccacgcgaccttcaccacccggctgctctccagcacgcgcgtgccgaactacaacctgatcgtcatggacgaggcccacttcaccgaccccagctccgtggccgcccgggggtacatcagcacccgcgtcgagatgggcgaggccgcggccatcttcatgaccgccacgccgcccggggccaccgacccgttcccccagtccaacagccccatcgaggacatcgagcgggagatccccgagcgctcctggaacaccggcttcgactggatcaccgactaccagggcaagacggtgtggttcgtgccgagcatcaaggccgggaacgacatcgcgaactgcctgcgcaagtccggcaagaaggtcatccagctcagccggaagaccttcgacaccgagtaccccaagaccaagctgacggactgggacttcgtggtgaccaccgacatctccgagatgggggccaacttccgcgccggccgggtcatcgacccccgccggtgcctgaagcccgtgatcctcaccgacgggccggagcgcgtgatcctggccggccccatccccgtcacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccgcggggagcagcgcaagaccttcgtggagctgatgcggcgcggcgacctgcccgtctggctcagctacaaggtggcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtctacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtcgcctccgggctgctgtgggtggccgagatccagccccagtggatcgcggccagcatcatcctcgagttcttcctgatggtgctgctcatcccggagcccgagaagcagcggacgccccaggacaaccagctgatctacgtcatcctgacgatcctcaccatcatcggcctgatcgccgccaacgagatggggctgatcgagaagaccaagaccgacttcggcttctaccaggtgaagacggagaccaccatcctcgacgtggacctgcgccccgcctccgcgtggaccctgtacgccgtcgccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtgcccctgctcgccatgggctgctacagccaggtcaaccccaccaccctgaccgcgtccctggtgatgctcctggtgcactacgccatcatcgggccgggcctgcaggccaaggccacgcgggaggcgcagaagcgcaccgccgccggcatcatgaagaaccccaccgtcgacgggatcaccgtgatcgacctcgagcccatcagctacgaccccaagttcgagaagcagctgggccaggtgatgctgctcgtcctgtgcgccgggcagctgctcctgatgcggacgacctgggccttctgcgaggtgctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtcgaccggaccgaggccaagagcgccctgaaggacgggtccaagatcaagcacgcggtgagccgcggctccagcaagatccggtggatcgtggagcgcgggatggtcaagcccaagggcaaggtggtggacctggggtgcggccgcggcgggtggtcctactacatggccacgctcaagaacgtcaccgaggtgaagggctacaccaagggcggcccggggcacgaggagcccatccccatggccacctacggctggaacctggtgaagctgcacagcggcgtcgacgtgttctacaagcccacggagcaggtcgacaccctcctgtgcgacatcggggagagctccagcaacccgaccatcgaggagggccggaccctgcgcgtcctcaagatggtggagccctggctgtccagcaagcccgagttctgcatcaaggtgctgaacccctacatgccgacggtcatcgaggagctggagaagctccagcggaagcacgggggcaacctggtgcgctgccccctgtcccggaacagcacccacgagatgtactgggtctccggcgccagcgggaacatcgtgtccagcgtgaacaccacctccaagatgctcctgaaccgcttcacgacccggcaccgcaagcccacctacgagaaggacgtcgacctgggcgcggggacccggagcgtgtccacggagatcgagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtgaacggcgtcgtgaagctgctcaccaagccctgggacgtgatcccgatggtcacccagctggccatgaccgacacgacccccttcgggcagcagcgcgtgttcaaggagaaggtggacacccggacgccccagcccaagccgggcacgcgcatggtcatgaccaccaccgcgaactggctgtgggccctcctggggaagaagaagaacccccggctgtgcacgcgcgaggagttcatctccaaggtgcggagcaacgccgccatcggcgccgtgttccaggaggagcaggggtggaccagcgcgtccgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggcgccccaccacaagatcctggccaaggccatcttcaagctgacctaccagaacaaggtggtgaaggtcctccgccccaccccgcgcggggccgtgatggacatcatctcccgcaaggaccagcggggcagcggccaggtgggcacctacgggctgaacacgttcaccaacatggaggtccagctgatccgccagatggaggccgagggcgtgatcacccaggacgacatgcagaaccccaagggcctcaaggagcgggtggagaagtggctgcgcgagtgcggggtcgaccggctgaagcgcatggcgatctccggcgacgactgcgtggtgaagcccctcgacgagcggttcgggaccagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggccggctggtccctccgcgagacggcctgcctggggaaggcctacgcgcagatgtggagcctgatgtacttccaccggcgcgacctccggctggcctccatggccatctgcagcgccgtgcccaccgagtggttcccgaccagccgcaccacgtggtccatccacgcccaccaccagtggatgaccaccgaggacatgctgaaggtgtggaaccgggtctggatcgaggacaaccccaacatgatcgacaagacccccgtgcacagctgggaggacatcccctacctcggcaagcgcgaggacctgtggtgcgggtccctgatcggcctcagctcccgggcgacgtgggccaagaacatccacaccgccatcacccaggtgcgcaacctgatcggcaaggaggagtacgtcgactacatgagcgtgatgaagcggtactccgccccgagcgagtccgagggggtgctgtga

SEQ ID NO: 10508 - RNA, 9867 nt, synthetic construct
  misc_feature 1..9867: note = derived and/or modified CDS sequence (opt1) from DENV-4__KJ579240__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccgtgacctgcatcgccgtcggcgggatcacgctgttcctcggcttcaccgtgcaggccgacatggggtgcgtggtctcctggagcggccgcgagctgaagtgcgggtccggcatcttcgtggtggacaacgtccacacctggaccgagcagtacaagttccagcccgagagccccgcgcggctggccagcgccatcctcaacgcccacaaggacggcgtgtgcgggatccgctccacgacccggctggagaacgtgatgtggaagcagatcaccaacgagctgaactacgtcctctgggagggcgggcacgacctgaccgtggtggccggcgacgtcaagggcgtgctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtctgcgaccaccggctcatgtccgcggccatcaaggaccagaaggccgtgcacgccgacatgggctactggatcgagagctccaagaaccagacgtggcagatcgagcgcgcgagcctgatcgaggtgaagacctgcctgtggcccaagacccacaccctctggtccaacggggtcctggagagccagatgctgatccccaagtcctacgccggcccgttcagccagcacaactaccggcaggggtacgccacccagacggtgggcccctggcacctcgggaagctggagatcgacttcggcgagtgccccggcaccaccgtgaccatccaggagaactgcgaccaccgcgggccctccctgcgcacgaccaccgccagcggcaagctcgtcacccagtggtgctgccggagctgcacgatgccgcccctgcgcttcctgggggaggacggctgctggtacgggatggagatccggcccctctccgagaaggaggagaacatggtgaagagccaggtcaccgccggccagggcacctccgagaccttcagcatggggctgctgtgcctcacgctgttcgtggaggagtgcctgcgccggcgcgtgacccggaagcacatgatcctcgcggtcgtgatcaccctgtgcgccatcatcctgggcgggctcacctggatggacctgctgcgcgccctcatcatgctgggcgacacgatgtccggccggatcgggggccagacccacctggccatcatcgccgtgttcaagatgagccccgggtacgtcctcggcgtgttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtcacccagttcgacaacacgcaggtggggaccctggccctcagcctgaccttcatccgctccaccatgagcctggtgatggcctggcggacgatcatggccgtcctcttcgtggtgaccctgatccccctgtgccgcacctcctgcctccagaagcagagccactgggtcgagatcaccgcgctgatcctgggcgcccaggccctccccgtgtacctgatgacgctgatgaagggggcctcccggcgcagctggcccctcaacgagggcatcatggcggtggggctggtctccctgctcggcagcgccctgctgaagaacgacgtgccgctcgccggccccatggtggccgggggcctgctgctcgccgcgtacgtcatgtccgggagcagcgccgacctgtccctggagaaggccgccaacgtgcagtgggacgagatggccgacatcaccggcagctcccccatcatcgaggtgaagcaggacgaggacgggagcttctccatccgggacgtcgaggagaccaacatgatcaccctcctggtgaagctggcgctcatcacggtgagcggcctgtaccccctggccatcccgatcaccatgaccctctggtacatgtggcaggtcaagacccagcgctccggcgccctgtgggacgtgcccagccccgccgccacccagaaggcggccctgtccgagggggtgtaccggatcatgcagcgcggcctcttcgggaagacgcaggtcggcgtggggatccacatggagggcgtgttccacaccatgtggcacgtcacccggggcagcgtgatctgccacgagaccgggcgcctggagccctcctgggccgacgtgcgcaacgacatgatcagctacggcgggggctggcggctgggcgacaagtgggacaaggaggaggacgtccaggtgctcgccatcgagccggggaagaaccccaagcacgtgcagacgaagcccggcctgttcaagaccctgaccggggagatcggcgccgtcaccctcgacttcaagcccgggacgtccggcagcccgatcatcaaccgcaagggcaaggtgatcgggctgtacggcaacggggtggtcaccaagtccggcgactacgtgagcgcgatcacccaggccgagcggatcggggagcccgactacgaggtggacgaggacatcttccgcaagaagcggctgaccatcatggacctccaccccggcgccggcaagacgaagcgcatcctgccgtccatcgtccgggaggccctgaagcgccggctgcgcaccctcatcctggcgcccacccgggtggtggccgccgagatggaggaggccctgcgcgggctccccatccggtaccagacccccgccgtcaagagcgagcacacgggccgcgagatcgtggacctgatgtgccacgcgaccttcaccacccggctgctctccagcacgcgcgtgccgaactacaacctgatcgtcatggacgaggcccacttcaccgaccccagctccgtggccgcccgggggtacatcagcacccgcgtcgagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtgccgagcatcaaggccgggaacgacatcgcgaactgcctgcgcaagtccggcaagaaggtcatccagctcagccggaagaccttcgacaccgagtaccccaagaccaagctgacggactgggacttcgtggtgaccaccgacatctccgagatgggggccaacttccgcgccggccgggtcatcgacccccgccggtgcctgaagcccgtgatcctcaccgacgggccggagcgcgtgatcctggccggccccatccccgtcacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtctggctcagctacaaggtggcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtctacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtcgcctccgggctgctgtgggtggccgagatccagccccagtggatcgcggccagcatcatcctcgagttcttcctgatggtgctgctcatcccggagcccgagaagcagcggaccccccaggacaaccagctgatctacgtcatcctgacgatcctcaccatcatcggcctgatcgccgccaacgagatggggctgatcgagaagaccaagaccgacttcggcttctaccaggtgaagacggagaccaccatcctcgacgtggacctgcgccccgcctccgcgtggaccctgtacgccgtcgccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtgcccctgctcgccatgggctgctacagccaggtcaaccccaccaccctgaccgcgtccctggtgatgctcctggtgcactacgccatcatcgggccgggcctgcaggccaaggccacgcgggaggcgcagaagcgcaccgccgccggcatcatgaagaaccccaccgtcgacgggatcaccgtgatcgacctcgagcccatcagctacgaccccaagttcgagaagcagctgggccaggtgatgctgctcgtcctgtgcgccgggcagctgctcctgatgcggacgacctgggccttctgcgaggtgctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtcgaccggaccgaggccaagagcgccctgaaggacgggtccaagatcaagcacgcggtgagccgcggctccagcaagatccggtggatcgtggagcgcgggatggtcaagcccaagggcaaggtggtggacctggggtgcggccgcggcgggtggtcctactacatggccacgctcaagaacgtcaccgaggtgaagggctacaccaaggggggcccggggcacgaggagcccatccccatggccacctacggctggaacctggtgaagctgcacagcggcgtcgacgtgttctacaagcccacggagcaggtggacaccctcctgtgcgacatcggggagagctccagcaacccgaccatcgaggagggccggaccctgcgcgtcctcaagatggtggagccctggctgtccagcaagcccgagttctgcatcaaggtgctgaacccctacatgccgacggtcatcgaggagctggagaagctccagcggaagcacgggggcaacctggtgcgctgccccctgtcccggaacagcacccacgagatgtactgggtctccggcgccagcgggaacatcgtgtccagcgtgaacaccacctccaagatgctcctgaaccgcttcacgacccggcaccgcaagcccacctacgagaaggacgtcgacctgggcgcggggacccggagcgtgtccacggagatcgagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtgaacggcgtcgtgaagctgctcaccaagccctgggacgtgatcccgatggtcacccagctggccatgaccgacacgacccccttcgggcagcagcgcgtgttcaaggagaaggtggacacccggaccccccagcccaagccgggcacgcgcatggtcatgaccaccaccgcgaactggctgtgggccctcctggggaagaagaagaacccccggctgtgcacgcgcgaggagttcatctccaaggtgcggagcaacgccgccatcggcgccgtgttccaggaggagcaggggtggaccagcgcgtccgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggcgccccaccacaagatcctggccaaggccatcttcaagctgacctaccagaacaaggtggtgaaggtcctccgccccaccccgcggggggccgtgatggacatcatctcccgcaaggaccagcggggcagcgggcaggtgggcacctacgggctgaacacgttcaccaacatggaggtccagctgatccgccagatggaggccgagggcgtgatcacccaggacgacatgcagaaccccaagggcctcaaggagcgggtggagaagtggctgcgcgagtgcggggtcgaccggctgaagcgcatggcgatctccggcgacgactgcgtggtgaagcccctcgacgagcggttcgggaccagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggccggctggtccctccgcgagacggcctgcctggggaaggcctacgcgcagatgtggagcctgatgtacttccaccggcgcgacctccggctggcctccatggccatctgcagcgccgtgcccaccgagtggttcccgaccagccgcaccacgtggtccatccacgcccaccaccagtggatgaccaccgaggacatgctgaaggtgtggaaccgggtctggatcgaggacaaccccaacatgatcgacaagacccccgtgcacagctgggaggacatcccctacctcggcaagcgcgaggacctgtggtgcgggtccctgatcggcctcagctcccgggcgacgtgggccaagaacatccacaccgccatcacccaggtgcgcaacctgatcggcaaggaggagtacgtcgactacatgagcgtgatgaagcggtactccgccccgagcgagtccgagggggtgctgtga

SEQ ID NO: 10509 - RNA, 9867 nt, synthetic construct
  misc_feature 1..9867: note = derived and/or modified CDS sequence (opt1) from DENV-4__KJ596658__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatcctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacgtacgggctgaacaccttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggacgagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtccccaccgagtggttcccgaccagccgcacgacctggtccatccacgcccaccaccagtggatgaccaccgaggacatgctgaaggtgtggaaccgggtgtggatcgaggacaaccccaacatgatcgacaagacgcccgtccacagctgggaggacatcccctacctcggcaagcgcgaggacctgtggtgcgggtccctgatcggcctcagctcccgggcgacctgggccaagaacatccacaccgccatcacccaggtgcgcaacctgatcggcaaggaggagtacgtggactacatgccggtcatgaagcggtacagcgccccctccgagagcgagggggtgctgtga

SEQ ID NO: 10510 - RNA, 9867 nt, synthetic construct
  misc_feature 1..9867: note = derived and/or modified CDS sequence (opt1) from DENV-4__KJ596659__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaaccacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatcctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacgtacgggctgaacaccttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggacgagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtccccaccgagtggttcccgaccagccgcacgacctggtccatccacgcccaccaccagtggatgaccaccgaggacatgctgaaggtgtggaaccgggtgtggatcgaggacaaccccaacatgatcgacaagacgcccgtccacagctgggaggacatcccctacctcggcaagcgcgaggacctgtggtgcgggtccctgatcggcctcagctcccgggcgacctgggccaagaacatccacaccgccatcacccaggtgcgcaacctgatcggcaaggaggagtacgtggactacatgccggtcatgaagcggtacagcgccccctccgagagcgagggggtgctgtga

SEQ ID NO: 10511 - RNA, 9867 nt, synthetic construct
  misc_feature 1..9867: note = derived and/or modified CDS sequence (opt1) from DENV-4__KJ596661__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatcgagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgacgctgaccctgtgggaggggaaccccggccgcttctggaacaccaccatcgccgtgtccacggccaacatcttccggggcagctacctcgccggggccggcctggcgttctccctgatcaagaacgcccagaccccccgccgggggaccggcaccgccggggagaccctcggcgagaagtggaagcgccagctgaacagcctggaccggaaggagttcgaggagtacaagcgctccggcatcctcgaggtggaccggacggaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccaccctcaagaacgtgaccgaggtcaagggctacaccaaggggggcccggggcacgaggagcccatccccatggccacgtacggctggaacctggtgaagctgcacagcggcgtggacgtcttctacaagcccaccgagcaggtggacaccctcctgtgcgacatcggggagagctccagcaacccgaccatcgaggagggccggacgctgcgcgtgctcaagatggtcgagccctggctgtccagcaagcccgagttctgcatcaaggtgctgaacccctacatgccgaccgtgatcgaggagctggagaagctccagcggaagcacgggggcaacctggtccgctgccccctgtcccggaacagcacccacgagatgtactgggtgtccggcgccagcgggaacatcgtctccagcgtgaacaccacgtccaagatgctcctgaaccgcttcaccacccggcaccgcaagcccacctacgagaaggacgtggacctgggcgcggggacgcggagcgtctccaccgagaccgagaagcccgacatgaccatcatcggccgccggctccagcgcctgcaggaggagcacaaggagacgtggcactacgaccaggagaacccgtaccggacctgggcctaccacgggagctacgaggccccctccaccggcagcgcctccagcatggtgaacggcgtggtcaagctgctcaccaagccctgggacgtgatcccgatggtgacgcagctggccatgaccgacaccacccccttcgggcagcagcgcgtcttcaaggagaaggtggacacgcggaccccccagcccaagccgggcacccgcatggtgatgaccacgaccgcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacacggccggctgggacacccggatcaccgaggacgacctgcagaacgaggagctcatcaccgagcagatggcgccccaccacaagatcctggccaaggccatcttcaagctgacctaccagaacaaggtcgtgaaggtgctccgccccacgccgcggggggccgtcatggacatcatctcccgcaaggaccagcggggcagcgggcaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggaccagcctgctgttcctcaacgacatgggcaaggcccgcaaggacatcccccagtgggagccgtccaaggggtggaagaactggcaggaggtgcccttctgcagccaccacttccacaagatcttcatgaaggacggccggtccctggtcgtgccctgccgcaaccaggacgagctgatcggccgggcccgcatcagccagggggccggctggtccctccgcgagaccgcctgcctggggaaggcgtacgcccagatgtggagcctgatgtacttccaccggcgcgacctccggctggcctccatggccatctgcagcgccgtgcccaccgagtggttcccgacgagccgcaccacctggtccatccacgcgcaccaccagtggatgaccacggaggacatgctgaaggtctggaaccgggtgtggatcgaggacaaccccaacatgatcgacaagacccccgtgcacagctgggaggacatcccctacctcggcaagcgcgaggacctgtggtgcgggtccctgatcggcctcagctcccgggccacctgggccaagaacatccacaccgccatcacgcaggtccgcaacctgatcggcaaggaggagtacgtggactacatgccggtgatgaagcggtacagcgccccctccgagagcgagggggtcctgtga

SEQ ID NO: 10512 - RNA, 9867 nt, synthetic construct
  misc_feature 1..9867: note = derived and/or modified CDS sequence (opt1) from DENV-4__KJ596663__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatcctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagaccctggccaaggccatcttcaagctgacctaccagaacaaggtcgtgaaggtgctccgccccacgccgcggggggccgtcatggacatcatctcccgcaaggaccagcggggcagcgggcaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtccccaccgagtggttcccgacgagccgcaccacctggtccatccacgcccaccaccagtggatgaccacggaggacatgctgaaggtgtggaaccgggtgtggatcgaggacaaccccaacatgatcgacaagacccccgtccacagctgggaggacatcccctacctcggcaagcgcgaggacctgtggtgcgggtccctgatcggcctcagctcccgggcgacctgggccaagaacatccacaccgccatcacgcaggtgcgcaacctgatcggcaaggaggagtacgtggactacatgccggtcatgaagcggtacagcgccccctccgagagcgagggggtgctgtga

SEQ ID NO: 10513 - RNA, 9867 nt, synthetic construct
  misc_feature 1..9867: note = derived and/or modified CDS sequence (opt1) from DENV-4__KJ596664__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatcgccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagatcgagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtgaacggcgtggtcaagctgctcaccaagccctgggacgtgatcccgatggtgacccagctggccatgaccgacacgacccccttcgggcagcagcgcgtcttcaaggagaaggtggacacccggaccccccagcccaagccgggcacgcgcatggtgatgaccaccaccgcgaactggctgtgggccctcctggggaagaagaagaacccccggctgtgcacgcgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacctacgggctgaacacgttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggaacctccgcgagacggcctgcctggggaaggcctacgcgcagatgtggtccctgatgtacttccaccggcgcgacctccggctggccagcatggccatctgctccgccgtccccaccgagtggttcccgaccagccgcaccacgtggagcatccacgcccaccaccagtggatgaccaccgaggacatgctgaaggtgtggaaccgggtgtggatcgaggacaaccccaacatgatcgacaagacccccgtccactcctgggaggacatcccctacctcggcaagcgcgaggacctgtggtgcgggagcctgatcggcctctccagccgggcgacgtgggccaagaacatccacaccgccatcacccaggtgcgcaacctgatcggcaaggaggagtacgtggactacatgtccgtcatgaagcggtacagcgccccgtccgagagcgagggggtgctgtga

SEQ ID NO: 10514 - RNA, 9867 nt, synthetic construct
  misc_feature 1..9867: note = derived and/or modified CDS sequence (opt1) from DENV-4__KJ596665__SS-prME
  source 1..9867: mol_type = other RNA
agcaccatcaccctgctctgcctgatccccacggtgatggccttccacctgtccacccgcgacggcgagcccctcatgatcgtggccaagcacgagcgggggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcggcctgaagtactcctggaagacctgggggaaggccaagatcttcacccccgaggcccggaacagcacgttcctgatcgacggccccgacacctccgagtgcccgaacgagcgccgggcctggaacagcttcgaggtggaggactacgggttcggcatgttcaccaccaacatctggatgaagttccgcgagggctccagcgaggtgtgcgaccaccggctcatgtccgcggccatcaaggaccagaaggccgtccacgccgacatggggtactggatcgagagctccaagaaccagacgtggcagatcgagcgcgcgagcctgatcgaggtgaagacctgcctgtggcccaagacccacaccctctggtccaacggcgtgctggagagccagatgctgatccccaagtcctacgccgggccgttcagccagcacaactaccggcagggctacgccacccagacggtcgggccctggcacctcggcaagctggagatcgacttcggcgagtgccccgggaccaccgtgaccatccaggagaactgcgaccaccgcggcccctccctgcgcacgaccaccgccagcgggaagctcgtgacccagtggtgctgccggagctgcacgatgccgcccctgcgcttcctgggcgaggacgggtgctggtacggcatggagatccggcccctctccgagaaggaggagaacatggtcaagagccaggtgaccgccggccaggggacctccgagaccttcagcatgggcctgctgtgcctcacgctgttcgtcgaggagtgcctgcgccggcgcgtgacccggaagcacatgatcctcgcggtggtcatcaccctgtgcgccatcatcctcggcgggctcacctggatggacctgctgcgcgccctcatcatcctgggggacacgatgtccgggcggatcggcgggcagacccacctggccatcatggccgtgttcaagatgagccccggctacgtgctcggggtcttcctgcgcaagctgacctcccgggagaccgcgctcatggtgatcggcatggccatgacgaccaccctgagcatcccgcacgacctgatggagctcatcgacggcatctccctggggctgatcctcctgaagatcgtgacccagttcgacaacacgcaggtcggcaccctggccctcagcctgaccttcatccgctccaccatgagcctggtgatggcctggcggacgatcatggccgtgctgttcgtcgtgaccctgatccccctgtgccgcacctcctgcctccagaagcagagccactgggtggagatcaccgcgctgatcctgggggcccaggccctccccgtctacctgatgacgctgatgaagggcgcctcccggcgcagctggcccctcaacgaggggatcatggcggtgggcctggtgtccctgctcggcagcgccctgctgaagaacgacgtcccgctcgccgggcccatggtggccggcgggctgctgctcgccgcgtacgtgatgtccggcagcagcgccgacctgtccctggagaaggccgccaacgtccagtgggacgagatggccgacatcaccgggagctcccccatcatcgaggtgaagcaggacgaggacggcagcttctccatccgggacgtggaggagaccaacatgatcaccctcctggtcaagctggcgctcatcacggtgagcggcctgtaccccctggccatcccgatcaccatgaccctctggtacatgtggcaggtcaagacccagcgctccggggccctgtgggacgtccccagccccgccgccacccagaaggcggccctgtccgagggcgtgtaccggatcatgcagcgcggcctcttcggcaagacccaggtgggggtcggcatccacatggagggcgtgttccacaccatgtggcacgtgacccgggggagcgtcatctgccacgagaccggccgcctggagccctcctgggccgacgtgcgcaacgacatgatcagctacgggggcggctggcggctgggggacaagtgggacaaggaggaggacgtgcaggtcctcgccatcgagccgggcaagaaccccaagcacgtgcagacgaagcccgggctgttcaagaccctgaccggcgagatcggggccgtgaccctcgacttcaagcccggcacgtccggcagcccgatcatcaaccgcaaggggaaggtcatcggcctgtacgggaacggcgtggtgaccaagtccggggactacgtcagcgcgatcacccaggccgagcggatcggcgagcccgactacgaggtggacgaggacatcttccgcaagaagcggctgaccatcatggacctccaccccggcgccgggaagacgaagcgcatcctgccgtccatcgtgcgggaggccctgaagcgccggctgcgcaccctcatcctggcgcccacccgggtcgtggccgccgagatggaggaggccctgcgcggcctccccatccggtaccagacccccgccgtcaagagcgagcacacggggcgcgagatcgtcgacctgatgtgccacgcgaccttcaccacccggctgctctccagcacgcgcgtgccgaactacaacctgatcgtgatggacgaggcccacttcaccgaccccagctccgtcgccgcccggggctacatcagcacccgcgtggagatgggggaggccgcggccatcttcatgaccgccacgccgcccggcgccaccgacccgttcccccagtccaacagccccatcgaggacatcgagcgggagatccccgagcgctcctggaacaccggcttcgactggatcaccgactaccaggggaagacggtctggttcgtgccgagcatcaaggccggcaacgacatcgcgaactgcctgcgcaagtccgggaagaaggtgatccagctcagccggaagaccttcgacaccgagtaccccaagaccaagctgacggactgggacttcgtcgtgaccaccgacatctccgagatgggcgccaacttccgcgccgggcgggtgatcgacccccgccggtgcctgaagcccgtcatcctcaccgacggcccggagcgcgtgatcctggccggccccatccccgtgacgcccgcgagcgccgcccagcggcgcgggcggatcggccgcaacccggcccaggaggacgaccagtacgtcttctccggggaccccctgaagaacgacgaggaccacgcccactggaccgaggcgaagatgctcctggacaacatctacacccccgagggcatcatccccaccctgttcggcccggagcgggagaagacgcaggccatcgacggggagttccgcctccggggcgagcagcgcaagaccttcgtggagctgatgcggcgcggggacctgcccgtgtggctcagctacaaggtcgcctccgccggcatcagctacaaggaccgggagtggtgcttcaccggggagcgcaacaaccagatcctggaggagaacatggaggtggagatctggacccgggagggcgagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcgcgggggccgcgcctaccagcacgccctcaacgagctgcccgagagcctggagacgctcatgctggtggccctgctcggggcgatgaccgccggcatcttcctgttcttcatgcaggggaagggcatcggcaagctgagcatggggctcatcaccatcgccgtggcctccggcctgctgtgggtcgccgagatccagccccagtggatcgcggccagcatcatcctcgagttcttcctgatggtgctgctcatcccggagcccgagaagcagcggacgccccaggacaaccagctgatctacgtgatcctgacgatcctcaccatcatcgggctgatcgccgccaacgagatgggcctgatcgagaagaccaagaccgacttcgggttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatgggcctgggcaaggggtggcccctccaccgcatggacctgggcgtgcccctgctcgccatggggtgctacagccaggtgaaccccaccaccctgaccgcgtccctggtcatgctcctggtgcactacgccatcatcggcccgggcctgcaggccaaggccacgcgggaggcgcagaagcgcaccgccgccgggatcatgaagaaccccaccgtggacggcatcaccgtcatcgacctcgagcccatcagctacgaccccaagttcgagaagcagctgggccaggtgatgctgctcgtgctgtgcgccggccagctgctcctgatgcggacgacctgggccttctgcgaggtcctgaccctcgcgaccgggccgatcctgacgctgtgggagggcaaccccggccgcttctggaacaccaccatcgccgtgtccaccgccaacatcttccgggggagctacctcgccggcgccgggctggcgttctccctgatcaagaacgcccagacgccccgccggggcaccgggaccgccggcgagaccctcggcgagaagtggaagcgccagctgaacagcctggaccggaaggagttcgaggagtacaagcgctccgggatcctcgaggtggaccggaccgaggccaagagcgccctgaaggacggctccaagatcaagcacgcggtcagccgcgggtccagcaagatccggtggatcgtggagcgcggcatggtgaagcccaaggggaaggtcgtggacctgggctgcggccgcgggggctggtcctactacatggccacgctcaagaacgtgaccgaggtcaaggggtacaccaagggcgggccgggccacgaggagcccatccccatggccacctacggctggaacctggtgaagctgcacagcggggtggacgtcttctacaagcccacggagcaggtcgacaccctcctgtgcgacatcggcgagagctccagcaacccgaccatcgaggaggggcggaccctgcgcgtgctcaagatggtcgagccctggctgtccagcaagcccgagttctgcatcaaggtgctgaacccctacatgccgacggtgatcgaggagctggagaagctccagcggaagcacggcggcaacctggtccgctgccccctgtcccggaacagcacccacgagatgtactgggtgtccggggccagcggcaacatcgtctccagcgtgaacaccacctccaagatgctcctgaaccgcttcacgacccggcaccgcaagcccacctacgagaaggacgtggacctgggggcgggcacccggagcgtctccacggagaccgagaagcccgacatgaccatcatcgggcgccggctccagcgcctgcaggaggagcacaaggagacctggcactacgaccaggagaacccgtaccggacgtgggcctaccacggcagctacgaggccccctccaccggcagcgcctccagcatggtgaacggggtggtcaagctgctcaccaagccctgggacgtgatcccgatggtgacccagctggccatgacggacaccacccccttcggccagcagcgcgtcttcaaggagaaggtggacacccggacgccccagcccaagccggggacccgcatggtgatgaccaccacggcgaactggctgtgggccctcctgggcaagaagaagaacccccggctgtgcacccgcgaggagttcatctccaaggtccggagcaacgccgccatcggggccgtgttccaggaggagcagggctggaccagcgcgtccgaggccgtgaacgacagccgcttctgggagctcgtcgacaaggagcgggccctgcaccaggagggcaagtgcgagtcctgcgtgtacaacatgatggggaagcgcgagaagaagctgggcgagttcgggcgcgccaagggcagccgggccatctggtacatgtggctcggggcgcgcttcctggagttcgaggccctgggcttcctcaacgaggaccactggttcggccgggagaactcctggagcggggtggagggcgaggggctgcaccgcctgggctacatcctcgaggagatcgacaagaaggacggcgacctgatgtacgccgacgacaccgccgggtgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggcgccgtcatggacatcatctcccgcaaggaccagcgggggagcggccaggtggggacgtacggcctgaacaccttcaccaacatggaggtgcagctgatccgccagatggaggccgagggcgtcatcacccaggacgacatgcagaaccccaaggggctcaaggagcgggtggagaagtggctgcgcgagtgcggcgtggaccggctgaagcgcatggcgatctccggggacgactgcgtcgtgaagcccctcgacgagcggttcggcacgagcctgctgttcctcaacgacatggggaaggtgcgcaaggacatcccccagtgggagccgtccaagggctggaagaactggcaggaggtccccttctgcagccaccacttccacaagatcttcatgaaggacggccggtccctggtggtgccctgccgcaaccaggacgagctgatcgggcgggcccgcatcagccagggcgccgggtggtccctccgcgagaccgcctgcctgggcaaggcctacgcgcagatgtggagcctgatgtacttccaccggcgcgacctccggctggcctccatggccatctgcagcgccgtccccaccgagtggttcccgaccagccgcacgacctggtccatccacgcccaccaccagtggatgaccaccgagaacatgctgaaggtgtggaaccgggtgtggatcgaggacaaccccaacatgatcgacaagacgcccgtccacagctgggaggacatcccctacctcgggaagcgcgaggacctgtggtgcggctccctgatcggcctcagctcccgggcgacctgggccaagaacatccacaccgccatcacccaggtgcgcaacctgatcgggaaggaggagtacgtggactacatgccggtcatgaagcggtacagcgccccctccgagagcgagggcgtgctgtga

SEQ ID NO: 10515 - RNA, 9867 nt, synthetic construct
  misc_feature 1..9867: note = derived and/or modified CDS sequence (opt1) from DENV-4__KJ596668__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatcctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccggtgaccatgaccctctggtacatgtggcaggtcaagacccagcgctccggcgccctgtgggacgtgcccagccccgccgccacccagaaggcggccctgtccgagggggtgtaccggatcatgcagcgcggcctcttcgggaagacgcaggtcggcgtggggatccacatggagggcgtgttccacaccatgtggcacgtcacccggggcagcgtgatctgccacgagaccgggcgcctggagccctcctgggccgacgtgcgcaacgacatgatcagctacggcgggggctggcggctgggcgacaagtgggacaaggaggaggacgtccaggtgctcgccatcgagccggggaagaaccccaagcacgtgcagacgaagcccggcctgttcaagaccctgaccggggagatcggcgccgtcaccctcgacttcaagcccgggacgtccggcagcccgatcatcaaccgcaagggcaaggtgatcgggctgtacggcaacggggtggtcaccaagtccggcgactacgtgagcgcgatcacccaggccgagcggatcggggagcccgactacgaggtggacgaggacatcttccgcaagaagcggctgaccatcatggacctccaccccggcgccggcaagacgaagcgcatcctgccgtccatcgtccgggaggccctgaagcgccggctgcgcaccctcatcctggcgcccacccgggtggtggccgccgagatggaggaggccctgcgcgggctccccatccggtaccagacccccgccgtcaagagcgagcacacgggccgcgagatcgtggacctgatgtgccacgcgaccttcaccacccggctgctctccagcacgcgcgtgccgaactacaacctgatcgtcatggacgaggcccacttcaccgaccccagctccgtggccgcccgggggtacatcagcacccgcgtcgagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtgccgagcatcaaggccgggaacgacatcgcgaactgcctgcgcaagtccggcaagaaggtcatccagctcagccggaagaccttcgacaccgagtaccccaagaccaagctgacggactgggacttcgtggtgaccaccgacatctccgagatgggggccaacttccgcgccggccgggtcatcgacccccgccggtgcctgaagcccgtgatcctcaccgacgggccggagcgcgtgatcctggccggccccatccccgtcacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtctggctcagctacaaggtggcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtctacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtcgcctccgggctgctgtgggtggccgagatccagccccagtggatcgcggccagcatcatcctcgagttcttcctgatggtgctgctcatcccggagcccgagaagcagcggaccccccaggacaaccagctgatctacgtcatcctgacgatcctcaccatcatcggcctgatcgccgccaacgagatggggctgatcgagaagaccaagaccgacttcggcttctaccaggtgaagacggagaccaccatcctcgacgtggacctgcgccccgcctccgcgtggaccctgtacgccgtcgccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtgcccctgctcgccatgggctgctacagccaggtcaaccccaccaccctgaccgcgtccctggtgatgctcctggtgcactacgccatcatcgggccgggcctgcaggccaaggccacgcgggaggcgcagaagcgcaccgccgccggcatcatgaagaaccccaccgtcgacgggatcaccgtgatcgacctcgagcccatcagctacgaccccaagttcgagaagcagctgggccaggtgatgctgctcgtcctgtgcgccgggcagctgctcctgatgcggacgacctgggccttctgcgaggtgctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtcgaccggaccgaggccaagagcgccctgaaggacgggtccaagatcaagcacgcggtgagccgcggctccagcaagatccggtggatcgtggagcgcgggatggtcaagcccaagggcaaggtggtggacctggggtgcggccgcggcgggtggtcctactacatggccacgctcaagaacgtcaccgaggtgaagggctacaccaaggggggcccggggcacgaggagcccatccccatggccacctacggctggaacctggtgaagctgcacagcggcgtcgacgtgttctacaagcccacggagcaggtggacaccctcctgtgcgacatcggggagagctccagcaacccgaccatcgaggagggccggaccctgcgcgtcctcaagatggtggagccctggctgtccagcaagcccgagttctgcatcaaggtgctgaacccctacatgccgacggtcatcgaggagctggagaagctccagcggaagcacgggggcaacctggtgcgctgccccctgtcccggaacagcacccacgagatgtactgggtctccggcgccagcgggaacatcgtgtccagcgtgaacaccacctccaagatgctcctgaaccgcttcacgacccggcaccgcaagcccacctacgagaaggacgtcgacctgggcgcggggacccggagcgtgtccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtcgtgaagctgctcaccaagccctgggacgtgatcccgatggtcacccagctggccatgacggacaccacccccttcgggcagcagcgcgtgttcaaggagaaggtggacacccggacgccccagcccaagccgggcacccgcatggtcatgaccaccacggcgaactggctgtgggccctcctggggaagaagaagaacccccggctgtgcacccgcgaggagttcatctccaaggtgcggagcaacgccgccatcggcgccgtgttccaggaggagcaggggtggaccagcgcgtccgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtggtgaaggtcctccgccccaccccgcggggggccgtgatggacatcatctcccgcaaggaccagcggggcagcgggcaggtgggcacgtacgggctgaacaccttcaccaacatggaggtccagctgatccgccagatggaggccgagggcgtgatcacccaggacgacatgcagaaccccaagggcctcaaggagcgggtggagaagtggctgcgcgagtacggggtcgaccggctgaagcgcatggcgatctccggcgacgactgcgtggtgaagcccctcgacgagcggttcgggacgagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtgcccaccgagtggttcccgaccagccgcacgacctggtccatccacgcccaccaccagtggatgaccaccgaggacatgctgaaggtgtggaaccgggtctggatcgaggacaaccccaacatgatcgacaagacgcccgtgcacagctgggaggacatcccctacctcggcaagcgcgaggacctgtggtgcgggtccctgatcggcctcagctcccgggcgacctgggccaagaacatccacaccgccatcacccaggtgcgcaacctgatcggcaaggaggagtacgtcgactacatgccggtgatgaagcggtacagcgccccctccgagagcgagggggtgctgtga

SEQ ID NO: 10516 - RNA, 9867 nt, synthetic construct
  misc_feature 1..9867: note = derived and/or modified CDS sequence (opt1) from DENV-4__KJ596670__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcgtgctgggcgggctcacctggatggacctgctgcgcgccctcatcatgctgggcgacacgatgtccggccggatcgggggccagacccacctggccatcatcgccgtgttcaagatgagccccgggtacgtcctcggcgtgttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtcacccagttcgacaacacgcaggtggggaccctggccctcagcctgaccttcatccgctccaccatgagcctggtgatggcctggcggacgatcatggccgtcctcttcgtggtgaccctgatccccctgtgccgcacctcctgcctccagaagcagagccactgggtcgagatcaccgcgctgatcctgggcgcccaggccctccccgtgtacctgatgacgctgatgaagggggcctcccggcgcagctggcccctcaacgagggcatcatggcggtggggctggtctccctgctcggcagcgccctgctgaagaacgacgtgccgctcgccggccccatggtggccgggggcctgctgctcgccgcgtacgtcatgtccgggagcagcgccgacctgtccctggagaaggccgccaacgtgcagtgggacgagatggccgacatcaccggcagctcccccatcatcgaggtgaagcaggacgaggacgggagcttctccatccgggacgtcgaggagaccaacatgatcaccctcctggtgaagctggcgctcatcacggtgagcggcctgtaccccctggccatcccgatcaccatgaccctctggtacatgtggcaggtcaagacccagcgctccggcgccctgtgggacgtgcccagccccgccgccacccagaaggcggccctgtccgagggggtgtaccggatcatgcagcgcggcctcttcgggaagacgcagatcggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagatcgagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtgaacggcgtggtcaagctgctcaccaagccctgggacgtgatcccgatggtgacccagctggccatgaccgacacgacccccttcgggcagcagcgcgtcttcaaggagaaggtggacacccggaccccccagcccaagccgggcacgcgcatggtgatgaccaccaccgcgaactggctgtgggccctcctggggaagaagaagaacccccggctgtgcacgcgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacctacgggctgaacacgttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagacggcctgcctggggaaggcctacgcgcagatgtggagcctgatgtacttccaccggcgcgacctccggctggcctccatggccatctgcagcgccgtccccaccgagtggttcccgaccagccgcaccacgtggtccatccacgcccaccaccagtggatgaccaccgaggacatgctgaaggtgtggaaccgggtgtggatcgaggacaaccccaacatgatcgacaagacccccgtccacagctgggaggacatcccctacctcggcaagcgcgaggacctgtggtgcgggtccctgatcggcctcagctcccgggcgacgtgggccaagaacatccacaccgccatcacccaggtgcgcaacctgatcggcaaggaggagtacgtggactacatgagcgtcatgaagcggtactccgccccgagcgagtccgagggggtgctgtga

SEQ ID NO: 10517 - RNA, 9867 nt, synthetic construct
  misc_feature 1..9867: note = derived and/or modified CDS sequence (opt1) from DENV-4__KJ596671__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatcgccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagatcgagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtgaacggcgtggtcaagctgctcaccaagccctgggacgtgatcccgatggtgacccagctggccatgaccgacacgacccccttcgggcagcagcgcgtcttcaaggagaaggtggacacccggaccccccagcccaagccgggcacgcgcatggtgatgaccaccaccgcgaactggctgtgggccctcctggggaagaagaagaacccccggctgtgcacgcgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacctacgggctgaacacgttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagacggcctgcctggggaaggcctacgcgcagatgtggagcctgatgtacttccaccggcgcgacctccggctggcctccatggccatctgcagcgccgtccccaccgagtggttcccgaccagccgcaccacgtggtccatccacgcccaccaccagtggatgaccaccgaggacatgctgaaggtgtggaaccgggtgtggatcgaggacaaccccaacatgatcgacaagacccccgtccacagctgggaggacatcccctacctcggcaagcgcgaggacctgtggtgcgggtccctgatcggcctcagctcccgggcgacgtgggccaagaacatccacaccgccatcacccaggtgcgcaacctgatcggcaaggaggagtacgtggactacatgagcgtcatgaagcggtactccgccccgagcgagtccgagggggtgctgtga

SEQ ID NO: 10518 - RNA, 9867 nt, synthetic construct
  misc_feature 1..9867: note = derived and/or modified CDS sequence (opt1) from DENV-4__KJ579241__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaagatcccgcacgcgaagcggcaggacgtgaccgtgctggggtcccaggagggcgccatgcacagcgccctggccggcgccaccgaggtcgacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtggtcaaggtgaagtacgagggcgccggggccccctgcaaggtgcccatcgagatccgggacgtcaacaaggagaaggtggtgggccgcgtcatcagcgccacgcccctggcggagaacaccaactccgtgaccaacatcgagctcgagccgcccttcggggacagctacatcgtgatcggcgtcggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtgcaccaggtcttcggctccgtgtacaccacgatgttcgggggcgtgagctggatgatccgcatcctcatcgggttcctggtcctgtggatcggcaccaactcccggaacaccagcatggccatgacctgcatcgccgtgggcgggatcacgctgttcctcggcttcaccgtgcaggccgacatggggtgcgtcgtgtcctggagcggccgcgagctgaagtgcgggtccggcatcttcgtggtcgacaacgtgcacacctggaccgagcagtacaagttccagcccgagagccccgcgcggctggccagcgccatcctcaacgcccacaaggacggcgtgtgcgggatccgctccacgacccggctggagaacgtcatgtggaagcagatcaccaacgagctgaactacgtgctctgggagggcgggcacgacctgaccgtggtcgccggcgacgtgaagggcgtgctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtcgaggactacggcttcgggatgttcaccaccaacatctggatgaagttccgcgagggctccagcgaggtgtgcgaccaccggctcatgtccgcggccatcaaggaccagaaggccgtgcacgccgacatgggctactggatcgagagctccaagaaccagacgtggcagatcgagcgcgcgagcctgatcgaggtcaagacctgcctgtggcccaagacccacaccctctggtccaacggggtgctggagagccagatgctgatccccaagtcctacgccggcccgttcagccagcacaactaccggcaggggtacgccacccagacggtgggcccctggcacctcgggaagctggagatcgacttcggcgagtgccccggcaccaccgtcaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtgaagagccaggtcaccgccggccagggcacctccgagaccttcagcatggggctgctgtgcctcacgctgttcgtggaggagtgcctgcgccggcgcgtcacccggaagcacatgatcctcgcggtggtgatcaccctgtgcgccatcatcctgggcgggctcacctggatggacctgctgcgcgccctcatcatcctgggcgacacgatgtccggccggatcgggggccagacccacctggccatcatggccgtcttcaagatgagccccgggtacgtgctcggcgtgttcctgcgcaagctgacctcccgggagaccgcgctcatggtcatcgggatggccatgacgaccaccctgagcatcccgcacgacctgatggagctcatcgacggcatctccctgggcctgatcctcctgaagatcgtgacccagttcgacaacacgcaggtggggaccctggccctcagcctgaccttcatccgctccaccatgagcctggtcatggcctggcggacgatcatggccgtgctcttcgtggtcaccctgatccccctgtgccgcacctcctgcctccagaagcagagccactgggtggagatcaccgcgctgatcctgggcgcccaggccctccccgtgtacctgatgacgctgatgaagggggcctcccggcgcagctggcccctcaacgagggcatcatggcggtcgggctggtgtccctgctcggcagcgccctgctgaagaacgacgtgccgctcgccggccccatggtcgccgggggcctgctgctcgccgcgtacgtgatgtccgggagcagcgccgacctgtccctggagaaggccgccaacgtgcagtgggacgagatggccgacatcaccggcagctcccccatcatcgaggtcaagcaggacgaggacgggagcttctccatccgggacgtggaggagaccaacatgatcaccctcctggtgaagctggcgctcatcacggtcagcggcctgtaccccctggccatcccgatcaccatgaccctctggtacatgtggcaggtgaagacccagcgctccggcgccctgtgggacgtgcccagccccgccgccacccagaaggcggccctgtccgagggggtctaccggatcatgcagcgcggcctcttcgggaagacgcaggtgggcgtggggatccacatggagggcgtcttccacaccatgtggcacgtgacccggggcagcgtgatctgccacgagaccgggcgcctggagccctcctgggccgacgtccgcaacgacatgatcagctacggcgggggctggcggctgggcgacaagtgggacaaggaggaggacgtgcaggtgctcgccatcgagccggggaagaaccccaagcacgtccagacgaagcccggcctgttcaagaccctgaccggggagatcggcgccgtgaccctcgacttcaagcccgggacgtccggcagcccgatcatcaaccgcaagggcaaggtgatcgggctgtacggcaacggggtcgtgaccaagtccggcgactacgtgagcgcgatcacccaggccgagcggatcggggagcccgactacgaggtcgacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtggtcgccgccgagatggaggaggccctgcgcgggctccccatccggtaccagacccccgccgtgaagagcgagcacacgggccgcgagatcgtggacctgatgtgccacgcgaccttcaccacccggctgctctccagcacgcgcgtcccgaactacaacctgatcgtgatggacgaggcccacttcaccgaccccagctccgtggccgcccgggggtacatcagcacccgcgtcgagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtcccgagcatcaaggccgggaacgacatcgcgaactgcctgcgcaagtccggcaagaaggtgatccagctcagccggaagaccttcgacaccgagtaccccaagaccaagctgacggactgggacttcgtggtcaccaccgacatctccgagatgggggccaacttccgcgccggccgggtgatcgacccccgccggtgcctgaagcccgtgatcctcaccgacgggccggagcgcgtcatcctggccggccccatccccgtgacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtcgagctgatgcggcgcggcgacctgcccgtgtggctcagctacaaggtggcctccgccgggatcagctacaaggaccgggagtggtgcttcaccggcgagcgcaacaaccagatcctggaggagaacatggaggtcgagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtcgccctgctcggcgcgatgaccgccgggatcttcctgttcttcatgcagggcaaggggatcggcaagctgagcatgggcctcatcaccatcgccgtggcctccgggctgctgtgggtggccgagatccagccccagtggatcgcggccagcatcatcctcgagttcttcctgatggtcctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtgaagacggagaccaccatcctcgacgtcgacctgcgccccgcctccgcgtggaccctgtacgccgtggccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtccccctgctcgccatgggctgctacagccaggtgaaccccaccaccctgaccgcgtccctggtgatgctcctggtccactacgccatcatcgggccgggcctgcaggccaaggccacgcgggaggcgcagaagcgcaccgccgccggcatcatgaagaaccccaccgtggacgggatcaccgtgatcgacctcgagcccatcagctacgaccccaagttcgagaagcagctgggccaggtcatgctgctcgtgctgtgcgccgggcagctgctcctgatgcggacgacctgggccttctgcgaggtgctgaccctcgcgaccggcccgatcctgacgctgtgggaggggaaccccggccgcttctggaacaccaccatcgccgtctccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtgagccgcggctccagcaagatccggtggatcgtcgagcgcgggatggtgaagcccaagggcaaggtggtcgacctggggtgcggccgcggcgggtggtcctactacatggccacgctcaagaacgtgaccgaggtgaagggctacaccaaggggggcccggggcacgaggagcccatccccatggccacctacggctggaacctggtcaagctgcacagcggcgtggacgtgttctacaagcccacggagcaggtcgacaccctcctgtgcgacatcggggagagctccagcaacccgaccatcgaggagggccggaccatgcgcgtgctgaagatggtggagccctggctctccagcaagcccgagttctgcatcaaggtcctgaacccctacatgccgacggtgatcgaggagctggagaagctgcagcggaagcacgggggcaacctcgtgcgctgccccctgtcccggaacagcacccacgagatgtactgggtctccggcgccagcgggaacatcgtgtccagcgtcaacaccacctccaagatgctgctcaaccgcttcacgacccggcaccgcaagcccacctacgagaaggacgtggacctgggcgcggggacccggagcgtgtccacggagaccgagaagcccgacatgaccatcatcggccgccggctgcagcgcctccaggaggagcacaaggagacctggcactacgaccaggagaacccgtaccggacgtgggcctaccacgggagctacgaggccccctccaccggcagcgcctccagcatggtcaacggcgtggtgaagctgctgaccaagccctgggacgtcatcccgatggtgacccagctcgccatgacggacaccacccccttcgggcagcagcgcgtgttcaaggagaaggtcgacacccggacgccccagcccaagccgggcacccgcatggtgatgaccaccacggcgaactggctgtgggccctgctcgggaagaagaagaacccccggctgtgcacccgcgaggagttcatctccaaggtgcggagcaacgccgccatcggcgccgtcttccaggaggagcaggggtggaccagcgcgtccgaggccgtgaacgacagccgcttctgggagctggtggacaaggagcgggccctccaccaggagggcaagtgcgagtcctgcgtctacaacatgatgggcaagcgcgagaagaagctgggggagttcggccgcgccaaggggagccgggccatctggtacatgtggctgggcgcgcgcttcctcgagttcgaggccctggggttcctgaacgaggaccactggttcggccgggagaactcctggagcggcgtggagggggagggcctccaccgcctggggtacatcctggaggagatcgacaagaaggacggcgacctcatgtacgccgacgacaccgccggctgggacacgcggatcaccgaggacgacctgcagaacgaggagctgatcaccgagcagatggcgccccaccacaagatcctcgccaaggccatcttcaagctgacctaccagaacaaggtggtcaaggtgctgcgccccaccccgcggggggccgtgatggacatcatctcccgcaaggaccagcggggcagcgggcaggtcggcacgtacgggctcaacaccttcaccaacatggaggtgcagctgatccgccagatggaggccgagggcgtgatcacccaggacgacatgcagaaccccaagggcctgaaggagcgggtcgagaagtggctccgcgagtgcggggtggaccggctgaagcgcatggcgatctccggcgacgactgcgtggtcaagcccctggacgagcggttcgggacgagcctcctgttcctgaacgacatgggcaaggtgcgcaaggacatcccccagtgggagccgtccaaggggtggaagaactggcaggaggtgcccttctgcagccaccacttccacaagatcttcatgaaggacggccggtccctcgtcgtgccctgccgcaaccaggacgagctgatcggccgggcccgcatcagccagggggccggctggtccctgcgcgagaccgcctgcctcgggaaggcctacgcgcagatgtggagcctgatgtacttccaccggcgcgacctgcggctcgcctccatggccatctgcagcgccgtgcccaccgagtggttcccgaccagccgcacgacctggtccatccacgcccaccaccagtggatgaccaccgaggacatgctgaaggtctggaaccgggtgtggatcgaggacaaccccaacatgatcgacaagacgcccgtgcacagctgggaggacatcccctacctgggcaagcgcgaggacctctggtgcgggtccctgatcggcctgagctcccgggcgacctgggccaagaacatccacaccgccatcacccaggtccgcaacctcatcggcaaggaggagtacgtggactacatgccggtgatgaagcggtacagcgccccctccgagagcgagggggtcctgtga

SEQ ID NO: 10519 - RNA, 9867 nt, synthetic construct
  misc_feature 1..9867: note = derived and/or modified CDS sequence (opt1) from DENV-4__KJ596672__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatcgccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccatcgccgcccgggggtacatcagcacccgcgtcgagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtcccgagcatcaaggccgggaacgacatcgcgaactgcctgcgcaagtccggcaagaaggtgatccagctcagccggaagaccttcgacaccgagtaccccaagaccaagctgacggactgggacttcgtggtcaccaccgacatctccgagatgggggccaacttccgcgccggccgggtgatcgacccccgccggtgcctgaagcccgtgatcctcaccgacgggccggagcgcgtcatcctggccggccccatccccgtgacgcccgcgagcgccgcccagcggcgcggccggatcgggcgcaacccggcccaggaggacgaccagtacgtgttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtcgagctgatgcggcgcggcgacctgcccgtgtggctcagctacaaggtggcctccgccgggatcagctacaaggaccgggagtggtgcttcaccggcgagcgcaacaaccagatcctggaggagaacatggaggtcgagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtgatgctgcacaccaccgagcggggcgggcgcgcctaccagcacgccctcaacgagctgcccgagagcctggagacgctcatgctggtcgccctgctcggcgcgatgaccgccgggatcttcctgttcttcatgcagggcaaggggatcggcaagctgagcatgggcctcatcaccatcgccgtggcctccgggctgctgtgggtggccgagatccagccccagtggatcgcggccagcatcatcctcgagttcttcctgatggtcctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtgaagacggagaccaccatcctcgacgtcgacctgcgccccgcctccgcgtggaccctgtacgccgtggccacgaccatcctcaccccgatgctgcggcacaccatcgagaacacgagcgccaacctgtccctcgccgcgatcgccaaccaggccgccgtgctgatggggctgggcaagggctggcccctccaccgcatggacctgggggtccccctgctcgccatgggctgctacagccaggtgaaccccaccaccctgaccgcgtccctggtgatgctcctggtccactacgccatcatcgggccgggcctgcaggccaaggccacgcgggaggcgcagaagcgcaccgccgccggcatcatgaagaaccccaccgtggacgggatcaccgtgatcgacctcgagcccatcagctacgaccccaagttcgagaagcagctgggccaggtcatgctgctcgtgctgtgcgccgggcagctgctcctgatgcggacgacctgggccttctgcgaggtgctgaccctcgcgaccggcccgatcctgacgctgtgggaggggaaccccggccgcttctggaacaccaccatcgccgtctccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtgagccgcggctccagcaagatccggtggatcgtcgagcgcgggatggtgaagcccaagggcaaggtggtcgacctggggtgcggccgcggcgggtggtcctactacatggccacgctcaagaacgtgaccgaggtgaagggctacaccaaggggggcccggggcacgaggagcccatccccatggccacctacggctggaacctggtcaagctgcacagcggcgtggacgtgttctacaagcccacggagcaggtcgacaccctcctgtgcgacatcggggagagctccagcaacccgaccatcgaggagggccggaccctgcgcgtgctcaagatggtggagccctggctgtccagcaagcccgagttctgcatcaaggtcctgaacccctacatgccgacggtgatcgaggagctggagaagctccagcggaagcacgggggcaacctggtgcgctgccccctgtcccggaacagcacccacgagatgtactgggtctccggcgccagcgggaacatcgtgtccagcgtcaacaccacctccaagatgctcctgaaccgcttcacgacccggcaccgcaagcccacctacgagaaggacgtggacctgggcgcggggacccggagcgtgtccacggagatcgagaagcccgacatgaccatcatcggccgccggctccagcgcctgcaggaggagcacaaggagacctggcactacgaccaggagaacccgtaccggacctgggcctaccacgggagctacgaggccccctccacgggcagcgcctccagcatggtcaacggcgtggtgaagctgctcaccaagccctgggacgtcatcccgatggtgacccagctggccatgaccgacacgacccccttcgggcagcagcgcgtgttcaaggagaaggtcgacacccggaccccccagcccaagccgggcacgcgcatggtgatgaccaccaccgcgaactggctgtgggccctcctggggaagaagaagaacccccggctgtgcacgcgcgaggagttcatctccaaggtgcggagcaacgccgccatcggcgccgtcttccaggaggagcaggggtggaccagcgcgtccgaggccgtgaacgacagccgcttctgggagctcgtggacaaggagcgggccctgcaccaggagggcaagtgcgagtcctgcgtctacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacccggatcacggaggacgacctgcagaacgaggagctcatcaccgagcagatggcgccccaccacaagatcctggccaaggccatcttcaagctgacctaccagaacaaggtggtcaaggtgctccgccccaccccgcggggggccgtgatggacatcatctcccgcaaggaccagcggggcagcgggcaggtcggcacctacgggctgaacacgttcaccaacatggaggtgcagctgatccgccagatggaggccgagggcgtgatcacccaggacgacatgcagaaccccaagggcctcaaggagcgggtcgagaagtggctgcgcgagtgcggggtggaccggctgaagcgcatggcgatctccggcgacgactgcgtggtcaagcccctcgacgagcggttcgggaccagcctgctgttcctcaacgacatgggcaaggtgcgcaaggacatcccccagtgggagccgtccaaggggtggaagaactggcaggaggtgcccttctgcagccaccacttccacaagatcttcatgaaggacggccggtccctggtcgtgccctgccgcaaccaggacgagctgatcggccgggcccgcatcagccagggggccggctggtccctccgcgagacggcctgcctggggaaggcctacgcgcagatgtggagcctgatgtacttccaccggcgcgacctccggctggcctccatggccatctgcagcgccgtgcccaccgagtggttcccgaccagccgcaccacgtggtccatccacgcccaccaccagtggatgaccaccgaggacatgctgaaggtctggaaccgggtgtggatcgaggacaaccccaacatgatcgacaagacccccgtgcacagctgggaggacatcccctacctcggcaagcgcgaggacctgtggtgcgggtccctgatcggcctcagctcccgggcgacgtgggccaagaacatccacaccgccatcacccaggtccgcaacctgatcggcaaggaggagtacgtggactacatgagcgtgatgaagcggtactccgccccgagcgagtccgagggggtcctgtga

SEQ ID NO: 10520 - RNA, 9867 nt, synthetic construct
  misc_feature 1..9867: note = derived and/or modified CDS sequence (opt1) from DENV-4__KJ579242__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatcctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggtgttctccctgatcaagaacgcgcagacgccccgccgggggaccggcaccgccggggagaccctcggcgagaagtggaagcgccagctgaacagcctggaccggaaggagttcgaggagtacaagcgctccggcatcctcgaggtcgaccggaccgaggccaagagcgccctgaaggacgggtccaagatcaagcacgccgtgagccgcggctccagcaagatccggtggatcgtggagcgcgggatggtcaagcccaagggcaaggtggtggacctggggtgcggccgcggcgggtggtcctactacatggcgacgctcaagaacgtcaccgaggtgaagggctacaccaaggggggcccggggcacgaggagcccatccccatggccacctacggctggaacctggtgaagctgcacagcggcgtcgacgtgttctacaagcccacggagcaggtggacaccctcctgtgcgacatcggggagagctccagcaacccgaccatcgaggagggccggaccatgcgcgtcctgaagatggtggagccctggctctccagcaagcccgagttctgcatcaaggtgctgaacccctacatgccgacggtcatcgaggagctggagaagctgcagcggaagcacgggggcaacctcgtgcgctgccccctgtcccggaacagcacccacgagatgtactgggtctccggcgccagcgggaacatcgtgtccagcgtgaacaccacctccaagatgctgctcaaccgcttcacgacccggcaccgcaagcccacctacgagaaggacgtcgacctgggcgccgggacccggagcgtgtccacggagaccgagaagcccgacatgaccatcatcggccgccggctgcagcgcctccaggaggagcacaaggagacctggcactacgaccaggagaacccgtaccggacgtgggcgtaccacgggagctacgaggccccctccaccggcagcgcctccagcatggtgaacggcgtcgtgaagctgctgaccaagccctgggacgtgatcccgatggtcacccagctcgccatgacggacaccacccccttcgggcagcagcgcgtgttcaaggagaaggtggacacccggacgccccagcccaagccgggcacccgcatggtcatgaccaccacggccaactggctgtgggcgctgctcgggaagaagaagaacccccggctgtgcacccgcgaggagttcatctccaaggtgcggagcaacgccgccatcggcgccgtgttccaggaggagcaggggtggaccagcgcctccgaggcggtcaacgacagccgcttctgggagctggtggacaaggagcgggccctccaccaggagggcaagtgcgagtcctgcgtgtacaacatgatgggcaagcgcgagaagaagctgggggagttcggccgcgccaaggggagccgggccatctggtacatgtggctgggcgcccgcttcctcgagttcgaggcgctggggttcctgaacgaggaccactggttcggccgggagaactcctggagcggcgtcgagggggagggcctccaccgcctggggtacatcctggaggagatcgacaagaaggacggcgacctcatgtacgccgacgacaccgccggctgggacacgcggatcaccgaggacgacctgcagaacgaggagctgatcaccgagcagatggccccccaccacaagatcctcgcgaaggccatcttcaagctgacctaccagaacaaggtggtgaaggtcctgcgccccaccccgcggggggccgtgatggacatcatctcccgcaaggaccagcggggcagcgggcaggtgggcacgtacgggctcaacaccttcaccaacatggaggtccagctgatccgccagatggaggccgagggcgtgatcacccaggacgacatgcagaaccccaagggcctgaaggagcgggtggagaagtggctccgcgagtgcggggtcgaccggctgaagcgcatggccatctccggcgacgactgcgtggtgaagcccctggacgagcggttcgggacgagcctcctgttcctgaacgacatgggcaaggtccgcaaggacatcccccagtgggagccgtccaaggggtggaagaactggcaggaggtgcccttctgcagccaccacttccacaagatcttcatgaaggacggccggtccctcgtggtcccctgccgcaaccaggacgagctgatcggccgggcgcgcatcagccagggggccggctggtccctgcgcgagaccgcctgcctcgggaaggcctacgcccagatgtggagcctgatgtacttccaccggcgcgacctgcggctcgcgtccatggccatctgcagcgccgtgcccaccgagtggttcccgaccagccgcacgacctggtccatccacgcccaccaccagtggatgaccaccgaggacatgctgaaggtgtggaaccgggtctggatcgaggacaaccccaacatgatcgacaagacgcccgtgcacagctgggaggacatcccctacctgggcaagcgcgaggacctctggtgcgggtccctgatcggcctgagctcccgggccacctgggcgaagaacatccacaccgccatcacccaggtgcgcaacctcatcggcaaggaggagtacgtcgactacatgccggtgatgaagcggtacagcgccccctccgagagcgagggggtgctgtga

SEQ ID NO: 10521 - RNA, 9867 nt, synthetic construct
  misc_feature 1..9867: note = derived and/or modified CDS sequence (opt1) from DENV-4__GQ398256__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagaacggggagcggcgccgggagaagcgctccgtggccctgacgccgcacagcggcatgggcctcgagacccgggccgagacctggatgtccagcgagggggcctggaagcacgcccagcgcgtggagtcctggatcctgcggaaccccggcttcgcgctgctcgccgggttcatggcctacatgatcggccagaccgggatccagcgcacggtcttcttcgtgctgatgatgctggtggcccccagctacggcatgcggtgcgtcggcgtggggaaccgcgacttcgtggagggcgtctccgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccagcatctccaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttcctgtgcagcggcaagatcaccgggaacctcgtccagatcgagaacctggagtacaccgtggccgtgaccgtccacaacggcgacacgcacgccgtgggcaacgacacctccagccacggggtcaccgccaccatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggaccgcgggcgccgacaccagcgaggtgcactggaaccacaaggagcgcatggtgacgttcaaggtcccgcacgccaagcggcaggacgtgaccgtgctggggtcccaggagggcgccatgcacagcgccctggcgggcgccaccgaggtcgacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtggtcaaggtgaagtacgagggcgccggggcgccctgcaaggtgcccatcgagatccgggacgtcaacaaggagaaggtggtgggccgcatcatcagctccacccccttcgccgagaacacgaacagcgtcaccaacatcgagctggagccgcccttcggggactcctacatcgtgatcggcgtgggcgagagcgccctcaccctgcactggttccggaaggggtccagcatcggcaagatgttcgagtccacctaccgcggggccaagcggatggcgatcctgggcgagacggcctgggacttcgggagcgtcggcggcctcttcacctccctggggaaggccgtgcaccaggtgttcggcagcgtctacaccaccatgttcgggggcgtgtcctggatggtgcgcatcctgatcgggttcctcgtcctgtggatcggcacgaacagccggaacacctccatggccatgacctgcatcgccgtgggcgggatcaccctgttcctgggcttcacggtgcaggcggacatggggtgcgtcgtgagctggaacggcaaggagctcaagtgcgggtccggcatcttcgtggtcgacaacgtgcacacctggaccgagcagtacaagttccagcccgagagccccgcccgcctggccagcgccatcctgaacgcccacaaggacggcgtgtgcgggatccggtccaccacgcgcctcgagaacgtcatgtggaagcagatcaccaacgagctgaactacgtgctgtgggagggcgggcacgacctcaccgtggtcgcgggcgacgtgaagggcgtgctgaccaaggggaagcgggccctgacgccgcccgtcaacgacctcaagtacagctggaagacctggggcaaggccaagatcttcacccccgaggcccgcaactccaccttcctgatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgcggccatcaaggaccagaaggccgtccacgccgacatgggctactggatcgagagctccaagaaccagacctggcagatcgagaaggcgagcctcatcgaggtgaagacgtgcctgtggcccaagacccacaccctgtggtccaacggggtgctcgagagccagatgctgatcccccggtcctacgccggcccgttcagccagcacaactaccgccaggggtacgccacccagaccgtcggcccctggcacctggggaagctcgagatcgacttcggcgagtgccccggcacgaccgtggccatccgggaggactgcgaccaccgcgggccctccctgcgcaccaccacggccagcggcaagctggtgacccagtggtgctgccggtcctgcaccatgccgcccctccgcttcctgggggaggacggctgctggtacgggatggagatccggcccctgagcgagaaggaggagaacatggtcaagagccaggtgaccgcgggccagggcacgtccgagaccttcagcatggggctcctgtgcctgaccctcttcgtcgaggagtgcctgcgccggcgcgtgacccggaagcacatgatcctggtggtcgtgatcacgttctgcgccatcatcctcggcgggctgacctggatggacctgctccgcgccctgatcatgctgggcgacaccatgtccggccggatcgggggccagatccacctcgccatcatggccgtgttcaagatgagccccgggtacgtcctgggcgtgttcctgcgcaagctcacctcccgggagacggcgctgatggtgatcgggatggccatgaccaccgtcttcagcatcccgcacgacctgatggagctcatcgacggcatctccctgggcctgatcctcctgaagatcgtgacccacttcgacaacacccaggtggggaccctggccctcagcctgaccttcctgcgctccaccatccccctcgtcatggcctggcggacgatcatggccgtgttcttcgtggtcaccctgatccccctgtgccgcaccagctgcctccagaagcagtcccactgggtggagatcaccgcgctgatcctgggcgcccaggccctccccgtgtacctgatgacgctgatgaagggggccagccggcgctcctggccgctcaacgagggcatcatggcggtcgggctggtgagcctgctcggctccgccctgctgaagaacgacgtgcccctcgccggccccatggtcgccgggggcctgctgctcgccgcgtacgtgatgagcgggtccagcgccgacctgtccctggagaaggccgccaacgtgcagtgggacgagatggccgacatcaccggcagcagccccatcatcgaggtcaagcaggacgaggacgggtccttcagcatccgggacgtggaggagaccaacatgatcaccctcctggtgaagctggcgctcatcacggtctccggcctgtacccgctggccatccccgtgaccatggccctctggtacatctggcaggtcaagacccagcgcagcggcgccctgtgggacgtcccctcccccgccgcgacccagaaggccacgctgagcgagggggtgtaccggatcatgcagcgcggcctcttcgggaagacccaggtgggcgtcgggatccacatggagggcgtgttccacaccatgtggcacgtgacccggggctccgtcatctgccacgagaccgggcgcctggagccgagctgggccgacgtgcgcaacgacatgatctcctacggcgggggctggcggctgggcgacaagtgggacaaggaggaggacgtgcaggtcctcgccatcgagcccgggaagaaccccaagcacgtgcagacgaagcccggcctgttcaagaccctgaccggggagatcggcgccgtgaccctcgacttcaagccggggacgagcggctcccccatcatcaacaagaagggcaaggtcatcgggctgtacggcaacggggtggtgaccaagagcggcgactacgtctccgcgatcacccaggccgagcgcatcggggagcccgactacgaggtggacgaggacatcttccggaagaagcgcctgaccatcatggacctccacccgggcgccggcaagacgaagcggatcctgcccagcatcgtgcgcgaggccctgaagcggcgcctccggaccctgatcctggcgcccacccgcgtcgtggccgccgagatggaggaggccctgcgggggctccccatccgctaccagaccccggccgtgaagtccgagcacacgggccgggagatcgtcgacctgatgtgccacgcgaccttcaccacccgcctgctcagctccacgcgggtgcccaactacaacctgatcgtcatggacgaggcccacttcaccgacccctgcagcgtggccgcccgcgggtacatctccacccgggtggagatgggcgaggccgcggccatcttcatgaccgccacgcccccgggggccaccgaccccttcccccagagcaacagccccatcgaggacatcgagcgcgagatcccggagcggtcctggaacaccggcttcgactggatcaccgactaccagggcaagacggtctggttcgtgcccagcatcaaggccgggaacgacatcgcgaactgcctgcgcaagtccggcaagcgcgtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagccggtcatcctcaccgacgggcccgagcgcgtgatcctggccggccccatccccgtgacgccggcgagcgccgcccagcggcgcggccggatcgggcgcaaccccgcccaggaggacgaccagtacgtcttctccggcgaccccctgaagaacgacgaggaccacgcccactggaccgaggcgaagatgctcctggacaacatctacacccccgaggggatcatcccgaccctgttcggccccgagcgggagaagacgcaggccatcgacggcgagttccgcctccgcggggagcagcgcaagaccttcgtggagctgatgaagcggggcgacctgcccgtgtggctcagctacaaggtcgcctccgccgggatcagctacaaggaccgcgagtggtgcttcaccggcgagcggaacaaccagatcctggaggagaacatggaggtggagatctggaccaaggagggggagaagaagaagctgcgccccaagtggctcgacgcccgggtgtacgcggacccgatggccctgaaggacttcaaggagttcgcctccggccgcaagagcatcacgctggacatcctcaccgagatcgcctccctgcccacctacctgagctccaaggccaagctcgcgctggacaacatcgtcatgctgcacaccaccgagaagggcgggcgggcctaccagcacgccctcaacgagctgcccgagagcctggagacgctcatgctggtggccctgctcggcgcgatgaccgccgggatcttcctgttcttcatgcagggcaaggggatcggcaagctgtccatgggcctcatcgccatcgccgtggccagcgggctgctgtgggtcgcggagatccagccgcagtggatcgccgcctccatcatcctcgagttcttcctgatggtgctgctcatccccgagcccgagaagcagcgcacgccccaggacaaccagctgatctacgtgatcctgaccatcctcacgatcatcggcctgatcgccgccaacgagatggggctgatcgagaagaccaagaccgacttcggcttctaccaggtcaagaccgagacgaccatcctcgacgtggacctgcgcccggcgagcgcctggaccctgtacgccgtggccaccacgatcctcacccccatgctgcggcacaccatcgagaacaccagcgccaacctgtccctcgcggccatcgccaaccaggccgccgtcctgatggggctgggcaagggctggcccctccaccgcatggacctgggggtgcccctgctcgcgatcggctgctacagccaggtgaacccgacgaccctgaccgcctccctggtcatgctcctggtgcactacgccatcatcgggcccggcctgcaggccaaggcgacccgggaggcccagaagcgcacggccgccggcatcatgaagaaccccaccgtggacgggatcaccgtcatcgacctcgagcccatcagctacgacccgaagttcgagaagcagctgggccaggtgatgctgctcgtgctgtgcgtcgggcagctgctcctgatgcggaccacgtgggccctgtgcgaggtgctcaccctggcgaccggccccgccatgaccctgtgggaggggaaccccggccgcttctggaacacgaccatcgccgtgtccaccgccaacatcttccggggcagctacctcgccggggcgggcctggccttctccctgatcaagaacgcccagacgccccggcgggggacgggcaccaccggggagaccctcggcgagaagtggaagcgccagctgaacagcctggaccggaaggagttcgaggagtacaagcgctccggcatcctcgaggtcgaccggacggaggccaagagcgccctgaaggacgggtccaagatcaagcacgcggtgagccgcggctccagcaagatccggtggatcgtggagcgcgggatggtcaagccgaagggcaaggtggtggacctggggtgcggccggggcgggtggtcctactacatggccaccctcaagaacgtcaccgaggtgaagggctacaccaagggcggccccgggcacgaggagcccatccccatggccacctacggctggaacctggtgaagctgcacagcggcgtcgacgtgttctacaagccgacggagcaggtcgacaccctcctgtgcgacatcggggagtccagctccaaccccaccatcgaggagggccgcaccctgcgggtcctcaagatggtggagccctggctgagcagcaagcccgagttctgcatcaaggtcctgaacccgtacatgcccacggtgatcgaggagctcgagaagctgcagcgccgctacgggggctccctggtgcggtgccccctgagccgcaactccacccacgagatgtactgggtcagcggcgcctccgggaacatcgtgagctccgtgaacaccatcagcaagatgctcctgaaccggttcaccacgcgccaccggaagcccacctacgagaaggacgtcgacctgggcgcggggacccgctccgtgagcaccgagacggagaagccggacatgaccgtgatcggccggcgcctccagcggctgcaggaggagcacaaggagacctggcactacgaccaggagaacccctaccgcacctgggcctaccacgggtcctacgaggcccccagcacgggctccgccagctccatggtcaacggcatcgtgaagctgctcaccaagccgtgggacgtgatccccatggtcacccagctggccatgaccgacacgacccccttcgggcagcagcgggtgttcaaggagaaggtggacacccgcacgccccagccgaagcccggcacgcggatgatcatgaccaccaccgcgaactggctgtgggccctcctggggaagaagaagtccccgcgcctgtgcacgcgggaggagttcatctccaaggtccgcagcaacgccgccatcggcgccgtgttccaggaggagcaggggtggacctccgcgagcgaggccgtgaacgacagccggttctgggagctcgtcaacaaggagcgcgccctgcaccaggagggcaagtgcgagtcctgcgtgtacaacatgatgggcaagcgggagaagaagctgggggagttcggccgcgccaaggggagccgggccatctggtacatgtggctcggcgcgcgcttcctggagttcgaggccctggggttcctcaacgaggaccactggttctcccgcgagaacagctggtccggcgtggagggcgaggggctgcaccggctgggctacatcctcgaggacatcgacaagcaggacggggacctgatctacgccgacgacaccgccggctgggacacccgcatcacggaggacgacctgctcaacgaggagctgatcaccgagcagatggcgccccaccacaagaccctggccaaggccatcttcaagctcacctaccagaacaaggtcgtgaaggtgctgcggcccacgcccaagggcgccgtcatggacatcatcagccgcaaggaccagcgggggtccggccaggtggggacctacggcctgaacaccttcaccaacatggaggtgcagctcatccgccagatggaggccgagggggtcatcacccaggacgacatgcagaaccccaagggcctgaaggagcgggtggagaagtggctgacggagtgcggcgtggaccgcctcaagcggatggcgatcagcggggacgactgcgtcgtgaagcccctggacgagcgcttctccgccagcctcctgttcctgaacgacatgggcaaggtgcggaaggacatcccgcagtgggagccctccaaggggtggaagaactggcaggaggtccccttctgcagccaccacttccacaagatcttcatgaaggacggccgctccctggtggtgccctgccggaaccaggacgagctcatcgggcgcgcccggatcagccagggcgccggctggtccctgcgcgagaccgcctgcctggggaaggcgtacgcccagatgtggagcctcatgtacttccaccggcgcgacctgcggctggcctccatggccatctgcagcgccgtcccgaccgagtggttccccaccagccgcacgacctggtccatccacgcgcaccaccagtggatgaccaccgaggacatgctcaaggtgtggaaccgcgtgtggatcgaggacaaccccaacatgacggacaagacccccgtccacagctgggaggacatcccgtacctgggcaagcgggaggacctgtggtgcgggtccctcatcggcctgagctcccgcgccacctgggccaagaacatccacaccgccatcacccaggtgcggaacctgatcgggaaggaggagtacgtggactacatgcccgtcatgaagcgctacagcgccccctccgagagcgagggcgtgctctga

SEQ ID NO: 10522 - RNA, 9867 nt, synthetic construct
  misc_feature 1..9867: note = derived and/or modified CDS sequence (opt1) from DENV-4__KC333651__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagaacggggagcggcgccgggagaagcgctccgtggccctgacgccgcacagcggcatgggcctcgagacccgggccgagacctggatgtccagcgagggggcctggaagcacgcccagcgcgtggagtcctggatcctgcggaaccccggcttcgcgctgctcgccgggttcatggcctacatgatcggccagaccgggatccagcgcatcgtcttcttcgtgctgatgatgctggtggcccccagctacggcatgcggtgcgtcggcgtggggaaccgcgacttcgtggagggcgtctccgggggcgcgtgggtggacctcgtgctggagcacggcgggtgcgtcacgaccatggcccagggcaagcccaccctggacttcgagctcaccaagacgaccgccaaggaggtggccctgctgcggacctactgcatcgaggccagcatctccaacatcaccacggcgacccgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcctgtgcagcggcaagatcacggggaacctcgtccagatcgagaacctggagtacaccgtggtggtcaccgtgcacaacggcgacacccacgccgtcggcaacgacacgtccaaccacggggtgaccgccaccatcacgccccggagcccctccgtggaggtcaagctgccggactacggcgagctcacgctggactgcgagccccggagcgggatcgacttcaacgagatgatcctgatgaagatgaagaagaagacctggctcgtgcacaagcagtggttcctggacctgcccctcccctggaccgccggcgcggacacctccgaggtgcactggaaccacaaggagcgcatggtcaccttcaaggtgccgcacgccaagcggcaggacgtgacggtcctggggagccaggagggcgccatgcactccgccctggccggcgcgaccgaggtggacagcggggacggcaaccacatgttcgccgggcacctcaagtgcaaggtgcgcatggagaagctgcgcatcaagggcatgagctacaccatgtgctccggcaagttcagcatcgacaaggagatggccgagacccagcacgggacgaccgtcgtgaaggtgaagtacgagggcgccggggccccctgcaaggtccccatcgagatccgggacgtgaacaaggagaaggtggtcggccgcatcatctccagcacccccttcgcggagaacaccaactccgtgacgaacatcgagctggagccgcccttcggggacagctacatcgtgatcggcgtcggcgagtccgccctcaccctgcactggttccggaaggggagctccatcggcaagatgttcgagagcacctaccgcggggccaagcggatggccatcctgggcgagaccgcgtgggacttcgggtccgtgggcggcctcttcacgagcctggggaaggccgtgcaccaggtcttcggctccgtgtacaccaccatgttcgggggcgtgagctggatggtccgcatcctgatcgggttcctcgtgctgtggatcggcaccaactcccggaacacgagcatggccatgacctgcatcgccgtgggcgggatcaccctgttcctgggcttcaccgtccaggccgacatggggtgcgtggtgtcctggaacggcaaggagctcaagtgcgggagcggcatcttcgtcgtggacaacgtgcacacgtggaccgagcagtacaagttccagcccgagtcccccgcgcgcctggccagcgccatcctgaacgcccacaaggacggcgtctgcgggatccggagcaccacccgcctcgagaacgtgatgtggaagcagatcacgaacgagctgaactacgtgctgtgggagggcgggcacgacctcaccgtcgtggccggcgacgtgaagggcgtcctgaccaaggggaagcgggcgctgaccccgcccgtgaacgacctcaagtactcctggaagacgtggggcaaggccaagatcttcacccccgaggcccgcaacagcaccttcctgatcgacgggcccgacacctccgagtgcccgaacgagcggcgcgcctggaacttcttcgaggtggaggactacggcttcgggatgttcacgaccaacatctggatgaagttccgggagggcagctccgaggtctgcgaccaccgcctgatgagcgccgcgatcaaggaccagaaggccgtgcacgccgacatgggctactggatcgagtccagcaagaaccagacctggcagatcgagaaggcctccctcatcgaggtgaagacctgcctgtggcccaagacgcacaccctgtggagcaacggggtcctcgagtcccagatgctgatcccccggagctacgcgggcccgttctcccagcacaactaccgccaggggtacgccacccagaccgtgggcccctggcacctggggaagctcgagatcgacttcggcgagtgccccggcaccacggtggccatccgggaggactgcgaccaccgcgggcccagcctgcgcaccaccaccgcctccggcaagctggtcacgcagtggtgctgccggagctgcaccatgccgcccctccgcttcctgggggaggacggctgctggtacgggatggagatccggcccctgtccgagaaggaggagaacatggtcaagagccaggtcaccgccggccagggcaccagcgagacgttctccatggggctcctgtgcctgaccctcttcgtggaggagtgcctgcgccggcgcgtgacccggaagcacatgatcctggtcgtggtgatcaccttctgcgcgatcatcctcggcgggctgacgtggatggacctgctccgcgccctgatcatgctgggcgacaccatgagcggccggatcgggggccagatccacctcgccatcatggccgtcttcaagatgtcccccgggtacgtgctgggcgtgttcctgcgcaagctcaccagccgggagaccgccctgatggtcatcgggatggcgatgacgaccgtgttctccatcccgcacgacctgatggagctcatcgacggcatcagcctgggcctgatcctcctgaagatcgtgacccacttcgacaacacccaggtcgggacgctggccctctccctgaccttcctgcgcagcaccatccccctcgtgatggcctggcggaccatcatggccgtgttcttcgtcgtgacgctgatccccctgtgccgcacctcctgcctccagaagcacagccactgggtggagatcaccgccctgatcctgggcgcgcaggccctccccgtctacctgatgaccctgatgaagggggcctcccggcgcagctggccgctcaacgagggcatcatggccgtggggctggtgtccctgctcggcagcgcgctgctgaagaacgacgtccccctcgccggccccatggtggccgggggcctgctgctcgccgcctacgtgatgtccgggagctccgcggacctgctgctcgagaaggccgccaacgtccagtgggacgagatggccgacatcacgggcagctcccccatcatcgaggtgaagcaggacgaggacgggagcttcagcatccgggacgtggaggagaccaacatgatgaccctgctggtcaagctcgccctgatcaccgtgtccggcctgtacccgctcgcgatccccgtgacgatggccctgtggtacatctggcaggtcaagacccagcgcagcggcgccctgtgggacgtgccctcccccgccgccacccagaaggcgaccctcagcgagggggtgtaccggatcatgcagcgcggcctgttcgggaagacgcaggtcggcgtggggatccacatggagggcgtgttccacaccatgtggcacgtcacccggggctccgtgatctgccacgagaccgggcgcctggagccgagctgggccgacgtgcgcaacgacatgatctcctacggcgggggctggcggctcggcgacaagtgggacaaggaggaggacgtccaggtgctggccatcgagcccgggaagaaccccaagcacgtgcagaccaagcccggcctgttcaagacgctcaccggggagatcggcgccgtcaccctggacttcaagccggggaccagcggctcccccatcatcaacaagaagggcaaggtgatcgggctgtacggcaacggggtggtcaccaagagcggcgactacgtgtccgccatcacccaggcggagcgcatcggggagcccgactacgaggtggacgaggacatcttccggaagaagcgcctcaccatcatggacctgcacccgggcgccggcaagaccaagcggatcctgcccagcatcgtccgcgaggccctcaagcggcgcctgcggacgctgatcctggcccccacccgcgtggtggcggccgagatggaggaggccctccgggggctgcccatccgctaccagaccccggccgtcaagtccgagcacaccggccgggagatcgtggacctgatgtgccacgccacgttcaccacccgcctcctgagctccacccgggtccccaactacaacctgatcgtgatggacgaggcgcacttcacggacccctgcagcgtggccgcccgcgggtacatctccacccgggtcgagatgggcgaggccgccgcgatcttcatgaccgccacgcccccgggggccacggaccccttcccccagagcaactcccccatcgaggacatcgagcgcgagatcccggagcggagctggaacaccggcttcgactggatcaccgactaccagggcaagaccgtgtggttcgtgcccagcatcaaggccgggaacgacatcgccaactgcctccgcaagtccggcaagcgcgtcatccagctgagccggaagacgttcgacaccgagtaccccaagaccaagctgaccgactgggacttcgtggtgacgaccgacatctccgagatgggggcgaacttccgcgccggccgggtcatcgacccccgccggtgcctcaagccggtgatcctgaccgacgggcccgagcgcgtgatcctggccggccccatccccgtcaccccggccagcgcggcccagcggcgcggccggatcgggcgcaaccccgcccaggaggacgaccagtacgtgttctccggcgaccccctcaagaacgacgaggaccacgcccactggacggaggccaagatgctgctggacaacatctacacccccgaggggatcatcccgaccctcttcggccccgagcgggagaagacccaggcgatcgacggcgagttccgcctgcgcggggagcagcgcaagacgttcgtggagctgatgaagcggggcgacctccccgtctggctgagctacaaggtggcctccgccgggatcagctacaaggaccgcgagtggtgcttcaccggcgagcggaacaaccagatcctggaggagaacatggaggtggagatctggaccaaggagggggagaagaagaagctccgccccaagtggctggacgcccgggtctacgccgacccgatggcgctgaaggacttcaaggagttcgcctccggccgcaagagcatcaccctcgacatcctgacggagatcgcctccctgcccacctacctcagctccaaggccaagctggccctggacaacatcgtgatgctccacaccaccgagaagggcgggcgggcgtaccagcacgccctgaacgagctgcccgagagcctcgagaccctgatgctggtggccctcctgggcgccatgacggcggggatcttcctgttcttcatgcagggcaaggggatcggcaagctctccatgggcctgatcgccatcgccgtcgccagcgggctgctctgggtggccgagatccagccgcagtggatcgcggcctccatcatcctggagttcttcctgatggtgctcctgatccccgagcccgagaagcagcgcacgccccaggacaaccagctgatctacgtcatcctcaccatcctgaccatcatcggcctgatcgccgccaacgagatggggctcatcgagaagacgaagaccgacttcggcttctaccaggtgaagaccgagaccacgatcctggacgtggacctgcgcccggccagcgcgtggaccctctacgccgtcgccaccaccatcctgacgcccatgctgcggcacaccatcgagaacacctccgccaacctcagcctggccgcgatcgccaaccaggccgccgtgctgatggggctcggcaagggctggcccctgcaccgcatggacctgggggtgcccctcctggccatcggctgctacagccaggtcaacccgaccacgctgaccgcgtccctcgtgatgctgctggtgcactacgccatcatcgggcccggcctccaggccaaggccacccgggaggcgcagaagcgcaccgccgccggcatcatgaagaaccccacggtcgacgggatcaccgtgatcgacctggagcccatcagctacgacccgaagttcgagaagcagctgggccaggtgatgctcctggtcctgtgcgccgggcagctcctgctgatgcggaccacctgggccctctgcgaggtgctgacgctggcgaccggccccgccatgaccctctgggaggggaaccccggccgcttctggaacaccacgatcgccgtgtccaccgccaacatcttccggggcagctacctggccggggcgggcctggccttctccctcatcaagaacgcccagacgccccgccgggggaccggcacgaccggggagaccctgggcgagaagtggaagcgccagctgaacagcctcgaccggaaggagttcgaggagtacaagcgctccggcatcctggaggtcgaccggaccgaggccaagagcgccctgaaggacgggtccaagatcaagcacgcggtgagccgcggctccagcaagatccggtggatcgtggagcgcgggatggtcaagccgaagggcaaggtggtggacctcgggtgcggccggggcgggtggtcctactacatggccacgctgaagaacgtcaccgaggtgaagggctacaccaagggcggccccgggcacgaggagcccatccccatggccacctacggctggaacctggtgaagctccacagcggcgtcgacgtgttctacaagccgaccgagcaggtcgacacgctgctgtgcgacatcggggagtccagctccaaccccaccatcgaggagggccgcaccctccgggtcctgaagatggtggagccctggctgagctccaagcccgagttctgcatcaaggtcctcaacccgtacatgcccaccgtgatcgaggagctggagaagctgcagcgccgctacgggggcagcctggtgcggtgccccctcagccgcaactccacgcacgagatgtactgggtcagcggcgcctccgggaacatcgtgagctccgtgaacaccatcagcaagatgctgctgaaccggttcaccacccgccaccggaagcccacgtacgagaaggacgtcgacctcggcgcggggacccgctccgtgagcaccgagaccgagaagccggacatgacggtgatcggccggcgcctgcagcggctgcaggaggagcacaaggagacctggcactacgaccaggagaacccctaccgcacctgggcctaccacgggtcctacgaggcccccagcaccggctccgccagctccatggtcaacggcgtggtgaagctcctgacgaagccgtgggacgtcatccccatggtgacccagctggccatgaccgacaccacgcccttcgggcagcagcgggtgttcaaggagaaggtcgacacccgcacgccccagccgaagcccggcacccggatgatcatgacgaccaccgcgaactggctctgggccctgctggggaagaagaagtccccgcgcctctgcacccgggaggagttcatctccaaggtgcgcagcaacgccgccatcggcgccgtgttccaggaggagcaggggtggacgtccgcgagcgaggccgtcaacgactcccggttctgggagctggtggacaaggagcgcgccctgcaccaggagggcaagtgcgagagctgcgtgtacaacatgatgggcaagcgggagaagaagctcggggagttcggccgcgccaaggggagccgggccatctggtacatgtggctgggcgcgcgcttcctggagttcgaggccctcgggttcctgaacgaggaccactggttctcccgcgagaacagctggtccggcgtcgagggcgaggggctgcaccggctcggctacatcctggaggacatcgacaagcaggagggggacctgatctacgccgacgacaccgccggctgggacacccgcatcaccgaggacgacctcctgaacgaggagctgatcacggagcagatggcgccccaccacaagaccctcgccaaggccatcttcaagctgacctaccagaacaaggtggtgaaggtcctgcggcccacccccaagggcgccgtgatggacatcatcagccgcaaggaccagcgggggtccggccaggtggggacgtacggcctcaacaccttcaccaacatggaggtccagctgatccgccagatggaggccgagggggtgatcacccaggacgacatgcagaaccccaagggcctgaaggagcgggtggagaagtggctcaccgagtgcggcgtcgaccgcctgaagcggatggcgatcagcggggacgactgcgtggtgaagcccctggacgagcgcttctccacgagcctcctgttcctgaacgacatgggcaaggtccggaaggacatcccgcagtgggagccctccaaggggtggaagaactggcaggaggtgcccttctgcagccaccacttccacaagatcttcatgaaggacggccgctccctcgtggtcccctgccggaaccaggacgagctgatcgggcgcgcccggatcagccagggcgccggctggtccctgcgcgagaccgcctgcctcgggaaggcctacgcgcagatgtggagcctgatgtacttccaccggcgcgacctgcggctcgcctccatggccatctgcagcgccgtgccgaccgagtggttccccacctcccgcacgacctggagcatccacgcccaccaccagtggatgaccaccgaggacatgctgaaggtgtggaaccgcgtctggatcgaggacaaccccaacatgacggacaagacccccgtgcacagctgggaggacatcccgtacctgggcaagcgggaggacctctggtgcgggtccctgatcggcctgagctcccgcgcgacctgggccaagaacatccacaccgccatcacccaggtgcggaacctcatcgggaaggaggactacgtcgactacatgcccgtgatgaagcgctacagcgccccctccgagagcgagggcgtgctgtga

SEQ ID NO: 10523 - RNA, 9867 nt, synthetic construct
  misc_feature 1..9867: note = derived and/or modified CDS sequence (opt1) from DENV-4__JN559740__SS-prME
  source 1..9867: mol_type = other RNA
agcaccatcaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcaccgtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcgcgccgtcggcaacgacatctccaaccacggggtgaccgccatgatcacgccccggagcccctccgtggaggtcaagctgccggactacggcgagctgaccctcgactgcgagccccgcagcgggatcgacttcaacgagatgatcctgatgaagatgaagaagaagacgtggctggtgcacaagcagtggttcctcgacctgcccctgccctggaccgccggcgcggacacctccgaggtgcactggaactacaaggagcggatggtcaccttcaaggtgccgcacgccaagcgccaggacgtgaccgtcctcgggagccaggagggcgccatgcacagcgccctggccggcgcgacggaggtggactccggggacggcaaccacatgttcgccgggcacctgaagtgcaaggtgcgcatggagaagctccggatcaagggcatgagctacaccatgtgctccggcaagttcagcatcgacaaggagatggccgagacccagcacgggaccacggtcgtgaaggtgaagtacgagggcgccggggccccctgcaaggtccccatcgagatccgcgacgtgaacaaggagaaggtggtcggccggatcatctccagcacgcccctggcggagaacaccaactccgtgaccaacatcgagctggagccgcccttcggggacagctacatcgtgatcggcgtcggcaactccgccctcacgctgcactggttccgcaaggggagctccatcggcaagatgttcgagagcacctaccgcggggccaagcgcatggccatcctgggcgagaccgcgtgggacttcgggtccgtgggcggcctcttcaccagcctggggaaggccgtgcaccaggtcttcggctccgtgtacacgaccatgttcgggggcgtgagctggatgatccggatcctgatcgggttcctcgtcctgtggatcggcaccaactcccgcaacaccagcatggccatgacgtgcatcgccgtgggcgggatcaccctgttcctgggcttcaccgtgcaggccgacatggggtgcgtcgtgtcctggagcggcaaggagctcaagtgcgggagcggcatcttcgtggtcgacaacgtgcacacctggacggagcagtacaagttccagcccgagtcccccgcgcggctggccagcgccatcctgaacgcccacaaggacggcgtgtgcgggatccgctccaccacccggctcgagaacgtcatgtggaagcagatcaccaacgagctgaactacgtgctgtgggagggcgggcacgacctcacggtggtcgccggcgacgtgaagggcgtgctgaccaaggggaagcgcgcgctgaccccgcccgtcagcgacctcaagtactcctggaagacctggggcaaggccaagatcttcacgcccgaggcccggaacagcaccttcctgatcgacgggcccgacacctccgagtgcccgaacgagcgccgggcctggaacagcctggaggtggaggactacggcttcgggatgttcaccacgaacatctggatgaagttccgcgagggctccagcgaggtgtgcgaccaccggctcatgtccgccgcgatcaaggaccagaaggccgtccacgccgacatgggctactggatcgagagctccaagaaccagacctggcagatcgagaaggccagcctgatcgaggtgaagacctgcctgtggcccaagacccacacgctctggtccaacggggtgctggagagccagatgctgatccccaagtcctacgcgggcccgttcagccagcacaactaccgccaggggtacgccacccagaccgtcggcccctggcacctcgggaagctggagatcgacttcggcgagtgccccggcaccaccgtgacgatccaggaggactgcgaccaccgggggcccagcctgcgcaccaccaccgcctccggcaagctcgtgacgcagtggtgctgccgcagctgcaccatgccgcccctgcggttcctgggggaggacggctgctggtacgggatggagatccgccccctctccgagaaggaggagaacatggtcaagagccaggtgaccgccggccagggcacctccgagacgttcagcatggggctgctgtgcctcaccctgttcgtcgaggagtgcctgcggcgccgggtgacccgcaagcacatgatcctcgtggtcgtgatcaccctgtgcgccatcatcctgggcgggctcacgtggatggacctgctgcgggcgctcatcatgctgggcgacaccatgtccggccgcatcgggggccagatccacctggccatcatggccgtgttcaagatgagccccgggtacgtcctcggcgtgttcctgcggaagctgacctcccgcgagaccgccctcatggtgatcgggatggccatgacgaccgtcctgagcatcccgcacgacctgatggagctcatcgacggcatctccctgggcctgatcctcctgaagatcgtgacccagttcgacaacacccaggtggggacgctggcgctcagcctgaccttcatccggtccaccatgcccctggtcatggcctggcgcaccatcatggccgtcctcttcgtggtcacgctgatccccctgtgccggaccagctgcctccagaagcagtcccactgggtggagatcaccgccctgatcctgggcgcccaggcgctccccgtgtacctgatgaccctgatgaagggggccagccgccggtcctggccgctcaacgagggcatcatggccgtcgggctggtgagcctgctcggctccgccctgctgaagaacgacgtgcccctcgcgggccccatggtcgccgggggcctgctgctcgccgcctacgtgatgagcgggagctccgccgacctgagcctggagaaggcggccaacgtgcagtgggacgagatggccgacatcacgggctccagccccatcatcgaggtcaagcaggacgaggacgggtccttcagcatccgcgacgtggaggagaccaacatgatcaccctcctggtgaagctggccctcatcaccgtctccggcctgtacccgctggccatccccgtgacgatgaccctctggtacatgtggcaggtcaagacccagcggagcggcgcgctgtgggacgtcccctcccccgccgccacccagaaggccgccctgagcgagggggtgtaccgcatcatgcagcggggcctcttcgggaagacccaggtgggcgtcgggatccacatggagggcgtgttccacaccatgtggcacgtgacccgcggctccgtcatctgccacgagaccgggcggctggagccgagctgggcggacgtgcgcaacgacatgatctcctacggcgggggctggcgcctgggcgacaagtgggacaaggaggaggacgtgcaggtcctcgccatcgagcccgggaagaaccccaagcacgtgcagaccaagcccggcctgttcaagacgctgaccggggagatcggcgccgtgaccctcgacttcaagccggggaccagcggctcccccatcatcaaccggaagggcaaggtcatcgggctgtacggcaacggggtggtgaccaagagcggcgactacgtctccgccatcacccaggccgagcgcatcggggagcccgactacgaggtggacgaggacatcttccggaagaagcgcctgaccatcatggacctccacccgggcgcgggcaagaccaagcggatcctgcccagcatcgtgcgcgaggccctgaagcggcgcctgcggacgctcatcctggcccccacccgcgtcgtggccgcggagatggaggaggccctgcgggggctccccatccgctaccagaccccggccgtgaagtccgagcacaccggccgggagatcgtcgacctgatgtgccacgccacgttcaccacccgcctgctcagcagcacccgggtgcccaactacaacctgatcgtcatggacgaggcccacttcacggacccctccagcgtggcggcccgcgggtacatctccacccgggtggagatgggcgaggccgccgccatcttcatgaccgcgacgcccccgggggccacggaccccttcccccagagcaactcccccatcgaggacatcgagcgcgagatcccggagcggagctggaacaccggcttcgactggatcaccgactaccagggcaagaccgtctggttcgtgccctccatcaaggccgggaacgacatcgccaactgcctgcgcaagagcggcaagaaggtgatccagctctcccgcaagacgttcgacaccgagtaccccaagaccaagctgaccgactgggacttcgtcgtgacgaccgacatcagcgagatgggggccaacttccgggcgggccgcgtgatcgacccccggcgctgcctgaagccggtcatcctcaccgacgggcccgagcgggtgatcctggccggccccatccccgtgaccccggcctccgccgcgcagcgccggggccgcatcgggcggaaccccgcccaggaggacgaccagtacgtcttcagcggcgaccccctgaagaacgacgaggaccacgcccactggacggaggccaagatgctcctggacaacatctacacccccgaggggatcatcccgaccctgttcggccccgagcgcgagaagacccaggccatcgacggcgagttccggctccgcggggagcagcggaagacgttcgtggagctgatgcgccggggcgacctgcccgtgtggctctcctacaaggtcgcgagcgccgggatctcctacaaggaccgcgagtggtgcttcaccggcgagcggaacaaccagatcctggaggagaacatggaggtggagatctggacccgcgagggggagaagaagaagctgcggccccgctggctcgacgcccgggtgtacgccgacccgatggccctgaaggacttcaaggagttcgcgagcggccgcaagtccatcaccctggacatcctcacggagatcgccagcctgcccacctacctgtccagccgcgccaagctcgccctggacaacatcgtcatgctgcacaccaccgagcggggcgggcgcgcctaccagcacgcgctcaacgagctgcccgagagcctggagaccctcatgctggtggccctgctcggcgccatgacggccgggatcttcctgttcttcatgcagggcaaggggatcggcaagctgtccatgggcctcatcaccatcgcggtggccagcgggctgctgtgggtcgccgagatccagccgcagtggatcgccgcctccatcatcctcgagttcttcctgatggtgctgctcatccccgagcccgagaagcagcggacgccccaggacaaccagctgatctacgtgatcctgaccatcctcacgatcatcggcctgatcgcggccaacgagatggggctgatcgagaagaccaagaccgacttcggcttctaccaggtcaagaccgagacgaccatcctcgacgtggacctgaagccggccagcgcctggaccctgtacgccgtggcgaccacgatcctcacccccatgctgcgccacaccatcgagaacacctccgccaacctgagcctcgccgccatcgccaaccaggcggccgtcctgatggggctgggcaagggctggcccctccaccggatggacctgggggtgcccctgctcgccatgggctgctactcccaggtgaacccgatcacgctgaccgccagcctggtcatgctcctggtgcactacgccatcatcgggcccggcctgcaggcgaaggccacccgcgaggcccagaagcggaccgccgcgggcatcatgaagaaccccacggtggacgggatcaccgtcatcgacctcgagcccatctcctacgacccgaagttcgagaagcagctgggccaggtgatgctgctcgtgctgtgcgccgggcagctgctcctgatgcgcaccacctgggccttctgcgaggtcctgacgctcgccaccggccccatcctgaccctgtgggaggggaaccccggccggttctggaacaccacgatcgccgtgagcaccgcgaacatcttccgcggctcctacctcgccggggccggcctggccttcagcctgatcaagaacgtgcagacgccccggcgcgggaccggcacgaccggggagaccctcggcgagaagtggaagcggcagctgaactccctggaccgcaaggagttcgaggagtacaagcggagcggcatcctcgaggtcgaccgcaccgaggccaagtccgcgctgaaggacgggagcaagatcaagcacgccgtgtcccggggcagctccaagatccgctggatcgtggagcgggggatggtcaagccgaagggcaaggtggtggacctggggtgcggccgcggcgggtggagctactacatggccacgctcaagaacgtcaccgaggtgaagggctacaccaagggcgggcccgggcacgaggagcccatccccatggccacctacggctggaacctggtgaagctgcacagcggcgtcgacgtgttctacaagccgaccgagcaggtcgacacgctcctgtgcgacatcggggagtccagctccaaccccaccatcgaggagggccgcaccctgcgggtcctcaagatggtggagccctggctgagctccaagcccgagttctgcatcaaggtcctgaacccgtacatgcccaccgtgatcgaggagctggagaagctccagcgcaagcacgggggcaacctggtgcggtgccccctgagccgcaactccacgcacgagatgtactgggtcagcggcgcctccgggaacatcgtgagctccgtgaacaccaccagcaagatgctcctgaaccggttcaccacgcgccaccggaagcccacctacgagaaggacgtcgacctgggcgcggggacccgctccgtgagcaccgagacggagaagccggacatgaccatcatcggccggcgcctccagcggctgcaggaggagcacaaggagacctggcactacgaccaggagaacccctaccgcacctgggcctaccacgggtcctacgaggcccccagcacgggctccgccagctccatggtgaacggcgtcgtgaagctgctcaccaagccgtgggacgtgatccccatggtcacccagctggcgatgaccgacacgacccccttcgggcagcagcgggtgttcaaggagaaggtggacacccgcacgccccagccgaagcccggcacgcggatggtcatgaccaccaccgccaactggctgtgggccctcctggggaagaagaagaacccccgcctgtgcacgcgggaggagttcatcagcaaggtgcgcagcaacgccgccatcggcgcggtgttccaggaggagcaggggtggacctccgccagcgaggccgtcaacgactcccggttctgggagctcgtggacaaggagcgcgccctgcaccaggagggcaagtgcgagagctgcgtgtacaacatgatgggcaagcgggagaagaagctgggggagttcggccgcgccaaggggtcccgcgcgatctggtacatgtggctcggcgcccggttcctggagttcgaggccctggggttcctcaacgaggaccactggttcggccgcgagaacagctggtccggcgtcgagggggagggcctgcaccggctggggtacatcctcgaggagatcgacaagaaggacggcgacctgatgtacgccgacgacaccgccggctgggacacccgcatcacggaggacgacctgcagaacgaggagctcatcaccgagcagatggcgccccaccacaagatcctggccaaggccatcttcaagctgacctaccagaacaaggtggtgaaggtcctccggccgacgccccgcggggccgtgatggacatcatcagccggaaggaccagcggggctccggccaggtgggcacgtacgggctgaacaccttcaccaacatggaggtccagctgatccggcagatggaggcggagggcgtgatcacccaggacgacatgcagaaccccaagggcctcaaggagcgcgtggagaagtggctgaaggagtgcggggtcgaccggctgaagcgcatggccatcagcggcgacgactgcgtggtgaagcccctcgacgagcggttcgggacctccctgctgttcctcaacgacatgggcaaggtccgcaaggacatcccgcagtgggagcccagcaaggggtggaagaactggcaggaggtgcccttctgctcccaccacttccacaagatcttcatgaaggacggccggagcctggtggtcccctgccgcaaccaggacgagctgatcggccgggcccgcatctcccagggggccggctggagcctccgggagacggcctgcctggggaaggcgtacgcccagatgtggtccctgatgtacttccaccgccgcgacctccggctggccagcatggccatctgcagcgccgtgccgaccgagtggttccccacctcccgcaccacgtggagcatccacgcgcaccaccagtggatgaccaccgaggacatgctgaaggtgtggaaccgggtctggatcgaggacaaccccaacatgaccgacaagacgcccgtgcactcctgggaggacatcccgtacctcggcaagcgcgaggacctgtggtgcgggagcctgatcggcctctccagccgggccacctgggccaagaacatccacaccgccatcacccaggtgcgcaacctgatcggcaaggaggagtacgtcgactacatgcccgtgatgaagcggtactccgcccccagcgagtccgagggggtgctgtga

SEQ ID NO: 10524 - RNA, 9867 nt, synthetic construct
  misc_feature 1..9867: note = derived and/or modified CDS sequence (opt1) from DENV-4__JN559741__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgggacgtggaggagaccaacatgatcaccctcctggtcaagctggcgctcatcacggtgagcggcctgtaccccctggccatcccgatcaccatgaccctctggtacatgtggcaggtgaagacccagcgctccggcgccctgtgggacgtccccagccccgccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccgtcctgatggggctgggcaagggctggcccctccaccgcatggacctgggggtgcccctgctcgccatgggctgctacagccaggtgaaccccaccaccctgaccgcgtccctggtcatgctcctggtgcactacgccatcatcgggccgggcctgcaggccaaggccacgcgggaggcgcagaagcgcaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggacgacctgggccttctgcgaggtcctgaccctcgcgaccggcccgatcctgacgctgtgggaggggaaccccggccgcttctggaacaccaccatcgccgtgtccaccgccaacatcttccggggcagctacctcgccggggccggcctggcgttctccctgatcaagaacgcccagacgccccgccgggggaccggcaccgccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgcggtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaaggggggcccggggcacgaggagcccatccccatggccacctacggctggaacctggtgaagctgcacagcggcgtggacgtcttctacaagcccacggagcaggtggacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtctccagcgtgaacaccacctccaagatgctcctgaaccgcttcacgacccggcaccgcaagcccacctacgagaaggacgtggacctgggcgcggggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcctccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcatggtgatgaccaccacggcgaactggctgtgggccctcctggggaagaagaagaacccccggctgtgcacccgcgaggagttcatctccaaggtccggagcaacgccgccatcggcgccgtgttccaggaggagcaggggtggaccagcgcgtccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgccgacgacaccgccggctgggacacgcggatcaccgaggacgacctgcagaacgaggagctcatcaccgagcagatggcgccccaccacaagatcctggccaaggccatcttcaagctgacctaccagaacaaggtcgtgaaggtgctccgccccaccccgcggggggccgtcatggacatcatctcccgcaaggaccagcggggcagcgggcaggtgggcacgtacgggctgaacaccttcaccaacatggaggtgcagctgatccgccagatggaggccgagggcgtcatcacccaggacgacatgcagaaccccaagggcctcaaggagcgggtggagaagtggctgcgcgagtgcggggtggaccggctgaagcgcatggcgatctccggcgacgactgcgtcgtgaagcccctcgacgagcggttcgggacgagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtccccaccgagtggttcccgaccagccgcacgacctggtccatccacgcccaccaccagtggatgaccaccgaggacatgctgaaggtgtggaaccgggtgtggatcgaggacaaccccaacatgatcgacaagacgcccgtccacagctgggaggacatcccctacctcggcaagcgcgaggacctgtggtgcgggtccctgatcggcctcagctcccgggcgacctgggccaagaacatccacaccgccatcacccaggtgcgcaacctgatcggcaaggaggagtacgtggactacatgccggtcatgaagcggtacagcgccccctccgagagcgagggggtgctgtga

SEQ ID NO: 10525 - RNA, 9867 nt, synthetic construct
  misc_feature 1..9867: note = derived and/or modified CDS sequence (opt1) from DENV-4__JQ513334__SS-prME
  source 1..9867: mol_type = other RNA
agcaccatcaccctgctctgcctgatccccaccgtgatggccttccacctgtccacccgcgacggcgagcccctcatgatcgtggccaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccatggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcgagaagatcaccggcaacctggtccagatcgagaacctcgagtacaccgtggtggtcaccgtgcacaacggggacacgcacgccgtcggcaacgacacctccaaccacggcgtgaccgccaccatcacgccccgcagcccctccgtggaggtcgagctgccggactacggggagctgaccctcgactgcgagccccggagcggcatcgacttcaacgagatgatcctgatgaagatgaagaagaagacctggctggtgcacaagcagtggttcctcgacctgcccctgccctgggccgcgggggccgacacctccgaggtgcactggaactacaaggagcgcatggtcaccttcaaggtgccgcacgccaagcggcaggacgtgacggtcctcggcagccaggagggggccatgcacagcgccctggcgggcgccaccgaggtggactccggcgacgggaaccacatgttcgccggccacctgaagtgcaaggtgcgcatggagaagctccgcatcaaggggatgagctacaccatgtgctccggcaagttcagcatcgacaaggagatggccgagacccagcacggcacgaccgtcgtgaaggtgaagtacgagggggccggcgcgccctgcaaggtccccatcgagatccgggacgtgaacaaggagaaggtggtcgggcgcgtgatctccagcatccccctggccgagaacaccaactccgtgaccaacatcgagctggagccgcccttcggcgacagctacatcgtcatcggggtgggcaactccgccctcacgctgcactggttccggaagggcagctccatcgggaagatgttcgagagcacctaccgcggcgccaagcgggtggcgatcctgggggagaccgcctgggacttcggctccgtcgggggcctcttcaccagcctgggcaaggccgtgcaccaggtgttcgggtccgtctacacgaccatgttcggcggggtgagctggatggtgcgcatcctgatcggcctcctggtcctgtggatcgggaccaactcccggaacaccagcatggccatgacgtgcatcgccgtgggcggcatcaccctgttcctcgggttcaccgtgcaggcggacatgggctgcgtcgtgtcctggagcgggcgcgagctgaagtgcggcagcgggatcttcgtggtcgacaacgtgcacacctggacggagcagtacaagttccagcccgagtcccccgcccggctggccagcgccatcctcaacgcccacaaggacggcgtgtgcggcatccgctccaccacccggctggagaacgtcatgtggaagcagatcaccaacgagctgaactacgtgctctgggagggcgggcacgacctgacggtggtcgcgggggacgtgaagggcgtgctgaccaagggcaagcgcgccctcaccccgcccgtcagcgacctgaagtactcctggaagacctgggggaaggccaagatcttcacgcccgaggcccggaacagcaccttcctgatcgacggccccgacacctccgagtgcccgaacgagcgccgggcctggaacagcctcgaggtggaggactacgggttcggcatgttcaccacgaacatctggatgaagttccgcgaggggtccagcgaggtgtgcgaccaccggctgatgtccgcggccatcaaggaccagaaggccgtccacgccgacatgggctactggatcgagagctccaagaaccagacctggcagatcgagaaggcgagcctgatcgaggtgaagacctgcctctggcccaagacccacacgctgtggtccaacggcgtgctggagagccagatgctcatccccaagtcctacgccgggccgttcagccagcacaactaccgccagggctacgccacccagaccgtcgggccctggcacctgggcaagctggagatcgacttcggggagtgccccggcaccaccgtgacgatccaggaggactgcgaccaccggggccccagcctccgcaccaccaccgcctccgggaagctggtcacgcagtggtgctgccgcagctgcaccatgccgcccctgcggttcctcggcgaggacgggtgctggtacggcatggagatccgccccctgtccgagaaggaggagaacatggtcaagagccaggtggccgcggggcagggcacctccgagaccttcagcatgggcctgctctgcctgacgctgttcgtcgaggagtgcctccggcgccgggtgacccgcaagcacatgatcctggccgtggtcatcaccctgtgcgccatcatcctcgggggcctgacctggatggacctgctccgggccctgatcatgctgggggacacgatgtccggccgcatcggcgggcagacccacctcgccatcatggcggtgttcaagatgagccccggctacgtgctgggggtcttcctgcggaagctcacctcccgcgagaccgccctgatggtgatcggcatggccatgacgaccaccctgagcatcccgcacgacctcatggagctgatcgacgggatctccctgggcctcatcctgctgaagatcgtgacccagttcgacaacacgcaggtcggcaccctcgccctgagcctgaccttcatccggtccaccatgagcctcgtgatggcctggcgcacgatcatggcggtgctgttcgtcgtgaccctgatccccctctgccggacctcctgcctgcagaagcagagccactgggtggagatcaccgccctgatcctcggggcccaggccctgcccgtctacctgatgacgctcatgaagggcgcgtcccgccggagctggcccctgaacgaggggatcatggccgtgggcctggtgtccctcctggggagcgccctgctcaagaacgacgtcccgctggccggccccatggtggccggcgggctgctcctggcggcctacgtgatgagcggctccagcgccgacctgtccctcgagaaggccgccaacgtccagtgggacgagatggcggacatcaccgggagctcccccatcatcgaggtgaagcaggacgaggacggcagcttctccatccgcgacgtggaggagaccaacatgatcaccctgctggtcaagctcgccctgatcacggtgagcgggctgtaccccctcgccatcccggtgaccatgaccctgtggtacatgtggcaggtcaagacccagcggtccggcgccctgtgggacgtgcccagccccgccgcgacgcagaaggccgccctctccgagggcgtgtaccgcatcatgcagcgggggctgttcggcaagacccaggtcggggtgggcatccacatggagggggtgttccacaccatgtggcacgtcacccgcggcagcgtgatctgccacgagaccggccggctggagccctcctgggccgacgtgcgcaacgacatgatcagctacgggggcgggtggcgcctcggcgacaagtgggacaaggaggaggacgtccaggtgctggccatcgagccgggcaagaaccccaagcacgtgcagacgaagcccgggctgttcaagaccctcaccggcgagatcggggcggtcaccctggacttcaagcccggcacgtccgggagcccgatcatcaaccggaagggcaaggtgatcggcctgtacgggaacggcgtggtcaccaagtccggggactacgtgagcgccatcacccaggccgagcgcatcggcgagcccgactacgaggtggacgaggacatcttccggaagaagcgcctcaccatcatggacctgcaccccggggccggcaagacgaagcggatcctgccgtccatcgtccgcgaggcgctgaagcggcgcctccggaccctgatcctggcccccacccgcgtggtggccgccgagatggaggaggccctccggggcctgcccatccgctaccagacccccgcggtcaagagcgagcacacggggcgggagatcgtggacctgatgtgccacgccaccttcaccacccgcctcctgagctccacgcgggtcccgaactacaacctgatcgtgatggacgaggcccacttcaccgaccccagctccgtggccgcccgcggctacatcagcacccgggtcgagatgggggaggcggccgccatcttcatgaccgccacgccgcccggcgccaccgacccgttcccccagtccaacagccccatcgaggacatcgagcgcgagatccccgagcggtcctggaacaccgggttcgactggatcaccgactaccagggcaagacggtgtggttcgtgccgagcatcaaggcgggcaacgacatcgccaactgcctccgcaagtccgggaagaaggtcatccagctgagccgcaagaccttcgacaccgagtaccccaagaccaagctgacggactgggacttcgtggtgaccaccgacatctccgagatgggcgccaacttccgggccgggcgcgtcatcgacccccggcgctgcctcaagcccgtgatcctgaccgacggcccggagcgggtgatcctggcggggcccatccccgtcacgcccgccagcgccgcccagcgccggggccgcatcggccggaacccggcccaggaggacgaccagtacgtgttctccggggaccccctcaagaacgacgaggaccacgcgcactggaccgaggccaagatgctgctggacaacatctacacccccgagggcatcatccccaccctcttcgggccggagcgcgagaagacgcaggccatcgacggcgagttccggctgcgcggcgagcagcggaagaccttcgtggagctgatgcgccgcggggacctccccgtctggctgagctacaaggtggcctccgccggcatcagctacaaggaccgcgagtggtgcttcaccggggagcggaacaaccagatcctggaggagaacatggaggtggagatctggacccgcgagggcgagaagaagaagctccggccccgctggctggacgcgcgggtctacgccgaccccatggccctgaaggacttcaaggagttcgcctccgggcgcaagagcatcacgctcgacatcctgaccgagatcgcctccctgccgacctacctcagcagccgcgcgaagctggccctggacaacatcgtgatgctccacaccaccgagcggggcggccgcgcctaccagcacgccctgaacgagctgcccgagtccctcgagacgctgatgctggtggcgctcctgggggccatgaccgccggcatcttcctgttcttcatgcaggggaagggcatcgggaagctcagcatgggcctgatcaccatcgccgtcgcctccggcctgctctgggtggcggagatccagccccagtggatcgccgccagcatcatcctggagttcttcctgatggtgctcctgatcccggagcccgagaagcagcggacgccccaggacaaccagctgatctacgtcatcctcgccatcctgacgatcatcgggctgatcgccgcgaacgagatgggcctcatcgagaagaccaagaccgacttcgggttctaccaggtgaagaccgagacgaccatcctggacgtggacctgcgccccgcctccgcctggaccctctacgccgtcgccaccacgatcctgaccccgatgctgcggcacaccatcgagaacaccagcgcgaacctctccctggccgccatcgccaaccaggccgcggtgctgatgggcctcgggaagggctggcccctgcaccgcatggacctgggcgtgcccctcctggccatggggtgctacagccaggtcaaccccacgaccctgaccgcctccctcgtgatgctgctggtgcactacgccatcatcggcccggggctccaggcgaaggccacccgggaggcccagaagcgcacggccgccggcatcatgaagaaccccaccgtcgacggcatcaccgtgatcgacctggagcccatcagctacgaccccaagttcgagaagcagctgggccaggtgatgctcctggtcctgtgcgcgggccagctcctgctgatgcggaccacgtgggccttctgcgaggtgctcaccctggccaccgggccgatcctgaccctctgggagggcaaccccgggcgcttctggaacacgaccatcgccgtgtccaccgccaacatcttccggggcagctacctggcgggcgccgggctggccttctccctcatcaagaacgcccagacgccccggcggggcacggggaccaccggcgagaccctgggggagaagtggaagcgccagctgaacagcctcgaccggaaggagttcgaggagtacaagcgctccggcatcctggaggtcgaccggacggaggccaagagcgcgctgaaggacggctccaagatcaagcacgccgtgagccgcgggtccagcaagatccggtggatcgtggagcgcggcatggtcaagcccaaggggaaggtggtggacctcggctgcgggcgcggcggctggagctactacatggccaccctgaagaacgtcaccgaggtgaaggggtacaccaagggcgggccgggccacgaggagcccatccccatggccacctacgggtggaacctggtgaagctccactccggcgtcgacgtgttctacaagcccacggagcaggtcgacaccctgctgtgcgacatcggcgagagctccagcaacccgaccatcgaggaggggcggaccctccgcgtcctgaagatggtggagccctggctgtccagcaagcccgagttctgcatcaaggtcctgaacccctacatgccgacggtgatcgaggagctcgagaagctgcagcggaagcacggcgggaacctggtgcgctgccccctctcccggaacagcacccacgagatgtactgggtctccggcgcgagcggcaacatcgtgtccagcgtgaacaccacctccaagatgctgctgaaccgcttcacgacccggcaccgcaagcccacctacgagaaggacgtcgacctcggggccggcacccggagcgtgtccacggagaccgagaagcccgacatgaccatcatcgggcgccggctgcagcgcctgcaggaggagcacaaggagacctggcactacgaccaggagaacccgtaccggacgtgggcctaccacggcagctacgaggccccctccaccgggagcgcctccagcatggtgaacggcgtcgtgaagctcctgaccaagccctgggacgtgatcccgatggtcacccagctggcgatgacggacaccacccccttcggccagcagcgcgtgttcaaggagaaggtggacacccggacgccccagcccaagccggggacccgcatggtcatgaccaccacggccaactggctctgggccctgctgggcaagaagaagaacccccggctctgcacccgcgaggagttcatcagcaaggtgcggtccaacgccgccatcggggcggtgttccaggaggagcagggctggaccagcgcctccgaggccgtcaacgacagccgcttctgggagctggtggacaaggagcgggccctgcaccaggaggggaagtgcgagtcctgcgtgtacaacatgatgggcaagcgcgagaagaagctcggcgagttcgggcgcgccaagggcagccgggcgatctggtacatgtggctgggggcccgcttcctggagttcgaggccctcggcttcctgaacgaggaccactggttcgggcgggagaactcctggagcggcgtcgagggcgaggggctgcaccgcctcggctacatcctggaggagatcgacaagaaggacggggacctgatgtacgccgacgacaccgcgggctgggacacgcggatcaccgaggacgacctccagaacgaggagctgatcaccgagcagatggcgccccaccacaagatcctggccaaggccatcttcaagctcacctaccagaacaaggtggtgaaggtcctgcgccccacgccgcggggcgccgtgatggacatcatctcccgcaaggaccagcgggggagcggccaggtggggacctacggcctgaacaccttcaccaacatggaggtccagctcatccgccagatggaggcggagggggtgatcacccaggacgacatgcagaaccccaagggcctgaaggagcgggtggagaagtggctgcgcgagtgcggcgtcgaccggctcaagcgcatggccatctccggggacgactgcgtggtgaagcccctggacgagcggttcggcacgagcctcctgttcctgaacgacatggggaaggtccgcaaggacatcccccagtgggagccgtccaagggctggaagaactggcaggaggtgcccttctgcagccaccacttccacaagatcttcatgaaggacgggcggtccctggtggtcccctgccgcaaccaggacgagctcatcggccgggcccgcatcagccagggcgccgggtggtccctgcgcgagaccgcctgcctgggcaaggcgtacgcccagatgtggagcctcatgtacttccaccggcgcgacctgcggctggccagcatggccatctgctccgccgtgcccaccgagtggttcccgaccagccgcacgacctggtccatccacgcgcaccaccagtggatgaccaccgaggacatgctcaaggtgtggaaccgggtctggatcgaggacaaccccaacatgatcgacaagacgcccgtgcacagctgggaggacatcccctacctggggaagcgcgaggacctgtggtgcggctccctcatcgggctgagctcccgggccacctgggccaagaacatccacaccgccatcacccaggtgcgcaacctgatcggcaaggaggagtacgtcgactacatgccggtgatgaagcggtacagcgccccctccgagagcgagggcgtgctctga

SEQ ID NO: 10526 - RNA, 9867 nt, synthetic construct
  misc_feature 1..9867: note = derived and/or modified CDS sequence (opt1) from DENV-4__JQ513336__SS-prME
  source 1..9867: mol_type = other RNA
agcaccatcaccctgctctgcctgatccccaccgtgatggccttccacctgtccacccgcgacggcgagcccctcatgatcgtggccaagcacgagcgggggcgccccctgctgttcaagaccaccgagggcatcaacaagtgcacgctcatcgccatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtgggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcgagaagatcaccggcaacctggtccagatcgagaacctcgagtacaccgtggtggtcaccgtgcacaacggggacacgcacgccgtcggcaacgacacctccaaccacggcgtgaccgccaccatcacgccccgcagcccctccgtggaggtcgagctgccggactacggggagctgaccctcgactgcgagccccggagcggcatcgacttcaacgagatgatcctgatgaagatgaagaagaagacctggctggtgcacaagcagtggttcctcgacctgcccctgccctgggccgcgggggccgacacctccgaggtgcactggaactacaaggagcgcatggtcaccttcaaggtgccgcacgccaagcggcaggacgtgacggtcctcggcagccaggagggggccatgcacagcgccctggcgggcgccaccgaggtggactccggcgacgggaaccacatgttcgccggccacctgaagtgcaaggtgcgcatggagaagctccgcatcaaggggatgagctacaccatgtgctccggcaagttcagcatcgacaaggagatggccgagacccagcacggcacgaccgtcgtgaaggtgaagtacgagggggccggcgcgccctgcaaggtccccatcgagatccgggacgtgaacaaggagaaggtggtcgggcgcgtgatctccagcatccccctggccgagaacaccaactccgtgaccaacatcgagctggagccgcccttcggcgacagctacatcgtcatcggggtgggcaactccgccctcacgctgcactggttccggaagggcagctccatcgggaagatgttcgagagcacctaccgcggcgccaagcggatggcgatcctgggggagaccgcctgggacttcggctccgtcgggggcctcttcaccagcctggggaaggccgtccaccaggtgttcgggtccgtgtacacgaccatgttcggcggggtcagctggatggtgcgcatcctgatcggcctcctggtgctgtggatcgggaccaactcccggaacaccagcatggccatgacgtgcatcgccgtcggcggcatcaccctgttcctcgggttcaccgtgcaggcggacatgggctgcgtggtctcctggagcgggcgcgagctgaagtgcggcagcgggatcttcgtggtggacaacgtccacacctggacggagcagtacaagttccagcccgagtcccccgcccggctggccagcgccatcctcaacgcccacaaggacggcgtgtgcggcatccgctccaccacccggctggagaacgtgatgtggaagcagatcaccaacgagctgaactacgtcctctgggagggcggccacgacctgacggtggtggcgggggacgtcaagggcgtgctgaccaagggcaagcgcgccctcaccccgcccgtgagcgacctgaagtactcctggaagacctgggggaaggccaagatcttcacgcccgaggcccggaacagcaccttcctgatcgacggccccgacacctccgagtgcccgaacgagcgccgggcctggaacagcctcgaggtcgaggactacgggttcggcatgttcaccacgaacatctggatgaagttccgcgaggggtccagcgaggtgtgcgaccaccggctgatgtccgcggccatcaaggaccagaaggccgtgcacgccgacatgggctactggatcgagagctccaagaaccagacctggcagatcgagaaggcgagcctgatcgaggtcaagacctgcctctggcccaagacccacacgctgtggtccaacggcgtgctggagagccagatgctcatccccaagtcctacgccgggccgttcagccagcacaactaccgccagggctacgccacccagaccgtggggccctggcacctgggcaagctggagatcgacttcggggagtgccccggcaccaccgtcacgatccaggaggactgcgaccaccggggccccagcctccgcaccaccaccgcctccgggaagctggtgacgcagtggtgctgccgcagctgcaccatgccgcccctgcggttcctcggcgaggacgggtgctggtacggcatggagatccgccccctgtccgagaaggaggagaacatggtcaagagccaggtggccgcggggcagggcacctccgagaccttcagcatgggcctgctctgcctgacgctgttcgtggaggagtgcctccggcgccgggtcacccgcaagcacatgatcctggccgtggtgatcaccctgtgcgccatcatcctcgggggcctgacctggatggacctgctccgggccctgatcatgctgggggacacgatgtccggccgcatcggcgggcagacccacctcgccatcatggcggtcttcaagatgagccccggctacgtgctgggggtgttcctgcggaagctcacctcccgcgagaccgccctgatggtcatcggcatggccatgacgaccaccctgagcatcccgcacgacctcatggagctgatcgacgggatctccctgggcctcatcctgctgaagatcgtgacccagttcgacaacacccaggtgggcaccctcgccctgagcctgaccttcatccggtccaccatgagcctcgtcatggcctggcgcacgatcatggcggtgctgttcgtggtcaccctgatccccctctgccggacctcctgcctgcagaagcagagccactgggtggagatcaccgccctgatcctcggggcccaggccctgcccgtgtacctgatgacgctcatgaagggcgcgtcccgccggagctggcccctgaacgaggggatcatggccgtcggcctggtgtccctcctggggagcgccctgctcaagaacgacgtgccgctggccggccccatggtcgccggcgggctgctcctggcggcctacgtgatgagcggctccagcgccgacctgtccctcgagaaggccgccaacgtgcagtgggacgagatggcggacatcaccgggagctcccccatcatcgaggtcaagcaggacgaggacggcagcttctccatccgcgacgtggaggagaccaacatgatcaccctgctggtgaagctcgccctgatcacggtcagcgggctgtaccccctcgccatcccggtgaccatgaccctgtggtacatgtggcaggtcaagacccagcggtccggcgccctgtgggacgtccccagccccgccgcgacgcagaaggccgccctctccgagggcgtgtaccgcatcatgcagcgggggctgttcggcaagacccaggtgggggtcggcatccacatggagggggtgttccacaccatgtggcacgtgacccgcggcagcgtcatctgccacgagaccggccggctggagccctcctgggccgacgtgcgcaacgacatgatcagctacgggggcgggtggcgcctcggcgacaagtgggacaaggaggaggacgtgcaggtcctggccatcgagccgggcaagaaccccaagcacgtgcagacgaagcccgggctgttcaagaccctcaccggcgagatcggggcggtgaccctggacttcaagcccggcacgtccgggagcccgatcatcaaccggaagggcaaggtcatcggcctgtacgggaacggcgtggtgaccaagtccggggactacgtcagcgccatcacccaggccgagcgcatcggcgagcccgactacgaggtggacgaggacatcttccggaagaagcgcctcaccatcatggacctgcaccccggggccggcaagacgaagcggatcctgccgtccatcgtgcgcgaggcgctgaagcggcgcctccggaccctgatcctggcccccacccgcgtcgtggccgccgagatggaggaggccctccggggcctgcccatccgctaccagacccccgcggtcaagagcgagcacacggggcgggagatcgtcgacctgatgtgccacgccaccttcaccacccgcctcctgagctccacgcgggtgccgaactacaacctgatcgtcatggacgaggcccacttcaccgaccccagctccgtggccgcccgcggctacatcagcacccgggtggagatgggggaggcggccgccatcttcatgaccgccacgccgcccggcgccaccgacccgttcccccagtccaacagccccatcgaggacatcgagcgcgagatccccgagcggtcctggaacaccgggttcgactggatcaccgactaccagggcaagacggtctggttcgtgccgagcatcaaggcgggcaacgacatcgccaactgcctccgcaagtccgggaagaaggtgatccagctgagccgcaagaccttcgacaccgagtaccccaagaccaagctgacggactgggacttcgtcgtgaccaccgacatctccgagatgggcgccaacttccgggccgggcgcgtgatcgacccccggcgctgcctcaagcccgtcatcctgaccgacggcccggagcgggtgatcctggcggggcccatccccgtgacgcccgccagcgccgcccagcgccggggccgcatcggccggaacccggcccaggaggacgaccagtacgtcttctccggggaccccctcaagaacgacgaggaccacgcgcactggaccgaggccaagatgctgctggacaacatctacacccccgagggcatcatccccaccctcttcgggccggagcgcgagaagacgcaggccatcgacggcgagttccggctgcgcggcgagcagcggaagaccttcgtggagctgatgcgccgcggggacctccccgtgtggctgagctacaaggtcgcctccgccggcatcagctacaaggaccgcgagtggtgcttcaccggggagcggaacaaccagatcctggaggagaacatggaggtggagatctggacccgcgagggcgagaagaagaagctccggccccgctggctggacgcgcgggtgtacgccgaccccatggccctgaaggacttcaaggagttcgcctccgggcgcaagagcatcacgctcgacatcctgaccgagatcgcctccctgccgacctacctcagcagccgcgcgaagctggccctggacaacatcgtcatgctccacaccaccgagcggggcggccgcgcctaccagcacgccctgaacgagctgcccgagtccctcgagacgctgatgctggtggcgctcctgggggccatgaccgccggcatcttcctgttcttcatgcaggggaagggcatcgggaagctcagcatgggcctgatcaccatcgccgtggcctccggcctgctctgggtcgcggagatccagccccagtggatcgccgccagcatcatcctggagttcttcctgatggtgctcctgatcccggagcccgagaagcagcggacgccccaggacaaccagctgatctacgtgatcctcgccatcctgacgatcatcgggctgatcgccgcgaacgagatgggcctcatcgagaagaccaagaccgacttcgggttctaccaggtcaagaccgagacgaccatcctggacgtggacctgcgccccgcctccgcctggaccctctacgccgtggccaccacgatcctgaccccgatgctgcggcacaccatcgagaacaccagcgcgaacctctccctggccgccatcgccaaccaggccgcggtcctgatgggcctcgggaagggctggcccctgcaccgcatggacctgggcgtgcccctcctggccatggggtgctacagccaggtgaaccccacgaccctgaccgcctccctcgtcatgctgctggtgcactacgccatcatcggcccggggctccaggcgaaggccacccgggaggcccagaagcgcacggccgccggcatcatgaagaaccccaccgtggacggcatcaccgtcatcgacctggagcccatcagctacgaccccaagttcgagaagcagctgggccaggtgatgctcctggtgctgtgcgcgggccagctcctgctgatgcggaccacgtgggccttctgcgaggtcctcaccctggccaccgggccgatcctgaccctctgggagggcaaccccgggcgcttctggaacacgaccatcgccgtgtccaccgccaacatcttccggggcagctacctggcgggcgccgggctggccttctccctcatcaagaacgcccagacgccccggcggggcacggggaccaccggcgagaccctgggggagaagtggaagcgccagctgaacagcctcgaccggaaggagttcgaggagtacaagcgctccggcatcctggaggtggaccggacggaggccaagagcgcgctgaaggacggctccaagatcaagcacgccgtcagccgcgggtccagcaagatccggtggatcgtggagcgcggcatggtgaagcccaaggggaaggtcgtggacctcggctgcgggcgcggcggctggagctactacatggccaccctgaagaacgtgaccgaggtcaaggggtacaccaagggcgggccgggccacgaggagcccatccccatggccacctacgggtggaacctggtgaagctccactccggcgtggacgtcttctacaagcccacggagcaggtcgacaccctgctgtgcgacatcggcgagagctccagcaacccgaccatcgaggaggggcggaccctccgcgtgctgaagatggtcgagccctggctgtccagcaagcccgagttctgcatcaaggtgctgaacccctacatgccgacggtcatcgaggagctcgagaagctgcagcggaagcacggcgggaacctggtgcgctgccccctctcccggaacagcacccacgagatgtactgggtgtccggcgcgagcggcaacatcgtctccagcgtgaacaccacctccaagatgctgctgaaccgcttcacgacccggcaccgcaagcccacctacgagaaggacgtggacctcggggccggcacccggagcgtctccacggagaccgagaagcccgacatgaccatcatcgggcgccggctgcagcgcctgcaggaggagcacaaggagacctggcactacgaccaggagaacccgtaccggacgtgggcctaccacggcagctacgaggccccctccaccgggagcgcctccagcatggtgaacggcgtggtcaagctcctgaccaagccctgggacgtgatcccgatggtgacccagctggcgatgacggacaccacccccttcggccagcagcgcgtcttcaaggagaaggtggacacccggacgccccagcccaagccggggacccgcatggtgatgaccaccacggccaactggctctgggccctgctgggcaagaagaagaacccccggctctgcacccgcgaggagttcatcagcaaggtccggtccaacgccgccatcggggcggtgttccaggaggagcagggctggaccagcgcctccgaggccgtgaacgacagccgcttctgggagctggtcgacaaggagcgggccctgcaccaggaggggaagtgcgagtcctgcgtgtacaacatgatgggcaagcgcgagaagaagctcggcgagttcgggcgcgccaagggcagccgggcgatctggtacatgtggctgggggcccgcttcctggagttcgaggccctcggcttcctgaacgaggaccactggttcgggcgggagaactcctggagcggcgtggagggcgaggggctgcaccgcctcggctacatcctggaggagatcgacaagaaggacggggacctgatgtacgccgacgacaccgcgggctgggacacgcggatcaccgaggacgacctccagaacgaggagctgatcaccgagcagatggcgccccaccacaagatcctggccaaggccatcttcaagctcacctaccagaacaaggtcgtgaaggtgctgcgccccacgccgcggggcgccgtcatggacatcatctcccgcaaggaccagcgggggagcggccaggtggggacctacggcctgaacaccttcaccaacatggaggtgcagctcatccgccagatggaggcggagggggtcatcacccaggacgacatgcagaaccccaagggcctgaaggagcgggtggagaagtggctgcgcgagtgcggcgtggaccggctcaagcgcatggccatctccggggacgactgcgtcgtgaagcccctggacgagcggttcggcacgagcctcctgttcctgaacgacatggggaaggtgcgcaaggacatcccccagtgggagccgtccaagggctggaagaactggcaggaggtccccttctgcagccaccacttccacaagatcttcatgaaggacgggcggtccctggtggtgccctgccgcaaccaggacgagctcatcggccgggcccgcatcagccagggcgccgggtggtccctgcgcgagaccgcctgcctgggcaaggcgtacgcccagatgtggagcctcatgtacttccaccggcgcgacctgcggctggccagcatggccatctgctccgccgtccccaccgagtggttcccgaccagccgcacgacctggtccatccacgcgcaccaccagtggatgaccaccgaggacatgctcaaggtgtggaaccgggtgtggatcgaggacaaccccaacatgatcgacaagacgcccgtccacagctgggaggacatcccctacctggggaagcgcgaggacctgtggtgcggctccctcatcgggctgagctcccgggccacctgggccaagaacatccacaccgccatcacccaggtgcgcaacctgatcggcaaggaggagtacgtggactacatgccggtcatgaagcggtacagcgccccctccgagagcgagggcgtgctctga

SEQ ID NO: 10527 - RNA, 9867 nt, synthetic construct
  misc_feature 1..9867: note = derived and/or modified CDS sequence (opt1) from DENV-4__JQ513338__SS-prME
  source 1..9867: mol_type = other RNA
agcaccatcaccctgctctgcctgatccccacggtgatggccttccacctgtccacccgggacggcgagcccctcatgatcgtggccaagcacgagcgggggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccccactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggagcagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcaacacgcccgccgtcggcaacgacaccagcaaccacggggtgaccgcccccatcacgccccgctcccccagcgtggaggtcaagctgcccgactacggcgagctcaccctggactgcgagccccggtccgggatcgacttcaacgagatgatcctgatgaagatgaagaagaagacctggctcgtgcacaagcagtggttcctggacctgccgctcccctggaccaccggcgccgacaccagcgaggtgcactggaactacaaggagcgcatggtcacgttcaaggtgccccacgcgaagcggcaggacgtgaccgtcctggggtcccaggagggcgccatgcacagcgccctggccggcgccaccgaggtggacagcggggacgagaaccacatgttcgcgggccacctcaagtgcaaggtgcgcatggggaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtcccgatcgagatccgggacgtgaacaaggagaaggtggtcggccgcgtgatcagcgccacgcccctggcggagaacacgaactccgtgaccaacatcgagctcgagccgcccttcggggaccggtacatcgtcatcggcgtgggcaacagcgccctgaccctgcactggttccgcaaggggtccagcatcggcaagatgttcgagtccacctaccgcggggccaagcgcatggccatcctcggcgagacggcgtgggacttcgggagcgtgggcggcctgttcacctccctggggaaggccgtccaccaggtgttcggcagcgtgtacaccaccatgttcgggggcgtctcctggatgatccggatcctcatcgggttcctggtgctgtggatcggcacgaacagccgcaacacctccatggccatgacctgcatcgccgtgggcgggatcaccctgttcctcggcttcacggtccaggccgacatggggtgcgtggtgagctggtccggccgggagctgaagtgcgggagcggcatcttcgtcgtggacaacgtgcacacctggaccgagcagtacaagttccagccggagtcccccgcgcgcctggccagcgccatcctcaacgcccacaaggacggcgtctgcgggatccggagcaccacgcgcctggagaacgtgatgtggaagcagatcaccaacgagctgaactacgtgctctgggagggcgggcacgacctgaccgtcgtggccggcgacgtgaagggcgtcctgaccaaggggaagcgggcgctcacgccgcccgcctccgacctgaagtacagctggaagacctggggcaaggccaagatcttcaccccggaggcccgcaactccaccttcctgatcgacgggcccgacacgagcgagtgccccaacgagcggcgcgcctggaactccttcgaggtggaggactacggcttcgggatgttcaccaccaacatctggatgaagttccgggagggcagctccgaggtgtgcgaccaccgcctcatgagcgcggccatcaaggaccagaaggccgtccacgccgacatgggctactggatcgagtccagcaagaaccagacctggcagatcgagcgggcgtccctgatcgaggtgaagacgtgcctgtggccgaagacccacaccctctggagcaacggggtgctggagtcccagatgctgatccccaagagctacgccggccccttctcccagcacaactaccgccaggggtacgccacccagaccgtcggcccctggcacctcgggaagctggagatcgacttcggcgagtgcccgggcacgaccgtgaccatccaggagaactgcgaccaccgcgggcccagcctgcggaccacgaccgcctccggcaagctcgtgacccagtggtgctgccgcagctgcaccatgccgcccctgcggttcctgggggaggacggctgctggtacgggatggagatccgcccgctcagcgagaaggaggagaacatggtcaagtcccaggtgacggccggccagggcaccagcgagaccttctccatggggctgctgtgcctcaccctgttcgtcgaggagtgcctgcggcgccgggtgacgcgcaagcacatgatcctcgcggtggtcatcaccctgtgcgccatcatcctgggcgggctcacctggatggacctgctgcgggccctcatcatgctgggcgacaccatgagcggccgcatcgggggccagacgcacctggccatcatggccgtgttcaagatgtcccccgggtacgtgctcggcgtcttcctgcggaagctgaccagccgcgagaccgcgctcatggtgatcgggatggccatgaccacgaccctgtccatcccccacgacctgatggagctcatcgacggcatcagcctgggcctgatcctcctgaagatcgtgacccagttcgacaacacccaggtcgggacgctggccctctccctgaccttcatccggagcaccatgtccctggtgatggcctggcgcaccatcatggccgtcctcttcgtcgtgacgctgatccccctgtgccggaccagctgcctccagaagcagtcccactgggtggagatcaccgcgctgatcctgggcgcccaggccctcccggtctacctgatgaccctgatgaagggggccagccgccggtcctggcccctcaacgagggcatcatggcggtggggctggtgagcctgctcggctccgccctgctgaagaacgacgtccccctcgccggccccatggtggccgggggcctgctgctcgccgcgtacgtgatgagcgggtccagcgccgacctgagcctggagaaggccgccaacgtccagtgggacgagatggccgacatcacgggctccagcccgatcatcgaggtgaagcaggacgaggacgggtccttcagcatccgcgacgtggaggagaccaacatgatcaccctcctggtcaagctggcgctcatcaccgtgtccggcctgtaccccctggccatccccatcacgatgaccctctggtacatgtggcaggtcaagacccagcggagcggcgccctgtgggacgtcccctccccggccgccacccagaaggcggccctgagcgagggggtgtaccgcatcatgcagcggggcctcttcgggaagacccaggtgggcgtcgggatccacatggagggcgtgttccacacgatgtggcacgtgacccgcggctccgtcatctgccacgagaccgggcgcctggagcccagctgggccgacgtgcggaacgacatgatctcctacggcgggggctggcgcctgggcgacaagtgggacaaggaggaggacgtgcaggtcctcgccatcgagcccgggaagaaccccaagcacgtgcagaccaagccgggcctgttcaagacgctgaccggggagatcggcgccgtgaccctcgacttcaagcccgggaccagcggctcccccatcatcaaccggaagggcaaggtcatcgggctgtacggcaacggggtggtgaccaagagcggcgactacgtctccgcgatcacccaggccgagcgcatcggggagccggactacgaggtggacgaggacatcttccggaagaagcgcctgaccatcatggacctccaccccggcgccggcaagaccaagcggatcctgcccagcatcgtgcgcgaggccctgaagcggcgcctgcggacgctcatcctggcgcccacccgcgtcgtggccgccgagatggaggaggccctgcgggggctcccgatccgctaccagacccccgccgtgaagtccgagcacaccggccgggagatcgtcgacctgatgtgccacgcgacgttcaccacccgcctgctcagctccacccgggtgcccaactacaacctgatcgtgatggacgaggcccacttcacggaccccagcagcgtcgccgcccgcgggtacatctccacccgggtggagatgggcgaggccgcggccatcttcatgaccgccaccccgcccggggccacggaccccttcccccagagcaactccccgatcgaggacatcgagcgcgagatccccgagcgcagctggaacaccggcttcgactggatcaccgactaccagggcaagaccgtctggttcgtgccctccatcaaggccgggaacgacatcgcgaactgcctgcgcaagagcggcaagaaggtgatccagctctcccgcaagacgttcgacaccgagtaccccaagaccaagctgaccgactgggacttcgtcgtgacgaccgacatcagcgagatgggggccaacttccgggccggccgcgtgatcgacccgcggcgctgcctgaagcccgtcatcctcaccgacgggcccgagcgggtgatcctggccggccccatcccggtgacccccgcgtccgccgcccagcgccggggccgcatcgggcggaaccccgcccaggaggacgaccagtacgtcttcagcggcgaccccctgaagaacgacgaggaccacgcccactggacggaggcgaagatgctcctggacaacatctacaccccggaggggatcatccccaccctgttcggccccgagcgcgagaagacccaggccatcgacggcgagttccggctccgcggggagcagcggaagacgttcgtggagctgatgcgccggggcgacctgcccgtgtggctctcctacaaggtcgccagcgccgggatctcctacaaggaccgcgagtggtgcttcaccggcgagcggaacaaccagatcctggaggagaacatggaggtggagatctggacccgcgagggggagaagaagaagctgcggccgaagtggctcgacgcccgcgtgtacgcggaccccatggccctgaaggacttcaaggagttcgccagcggccgcaagtccatcaccctggacatcctcaccgagatcgccagcctgcccacgtacctgtccagccgggccaagctcgcgctggacaacatcgtcatgctgcacaccaccgagcgcggcgggcgggcctaccagcacgccctcaacgagctgccggagtccctggagaccctcatgctggtggccctgctcggcgcgatgacggccgggatcttcctgttcttcatgcagggcaaggggatcggcaagctgagcatgggcctcatcaccatcgccgtggccagcgggctgctgtgggtcgccgagatccagccccagtggatcgcggcctccatcatcctcgagttcttcctgatggtgctgctcatccccgagcccgagaagcagcgcaccccgcaggacaaccagctgatctacgtgatcctgaccatcctcacgatcatcggcctgatcgccgccaacgagatggggctgatcgagaagaccaagaccgacttcggcttctaccaggtcaagaccgagacgaccatcctcgacgtggacctgcggcccgccagcgcgtggaccctgtacgccgtggccaccacgatcctcacccccatgctgcgccacaccatcgagaacacctccgccaacctgagcctcgccgcgatcgccaaccaggccgccgtcctgatggggctgggcaagggctggcccctccaccggatggacctgggggtgccgctgctcgccatgggctgctactcccaggtgaaccccacgaccctgaccgcgagcctggtcatgctcctggtgcactacgccatcatcgggcccggcctgcaggccaaggccacccgcgaggcgcagaagcggacggccgccggcatcatgaagaaccccaccgtggacgggatcaccgtcatcgacctcgagccgatctcctacgaccccaagttcgagaagcagctgggccaggtgatgctgctcgtgctgtgcgccgggcagctgctcctgatgcgcaccacgtgggccttctgcgaggtcctgaccctcgcgaccggccccatcctgaccctgtgggaggggaaccccggccggttctggaacacgaccatcgccgtgagcaccgccaacatcttccgcggctcctacctcgccggggccggcctggcgttcagcctgatcaagaacgcccagaccccgcggcgcgggacgggcaccaccggggagaccctcggcgagaagtggaagcggcagctgaactccctggaccgcaaggagttcgaggagtacaagcggagcggcatcctcgaggtggaccgcaccgaggccaagtccgccctgaaggacgggagcaagatcaagcacgccgtctcccggggcagctccaagatccgctggatcgtggagcgcgggatggtgaagcccaagggcaaggtcatcgacctggggtgcggccggggcgggtggagctactacatggcgacgctcaagaacgtgaccgaggtgaagggctacaccaagggcggccccgggcacgaggagcccatcccgatggccacctacggctggaacctggtcaagctgcactccggcgtggacgtgttctacaagcccacggagcaggtcgacaccctcctgtgcgacatcggggagagcagctccaaccccaccatcgaggagggccgcaccctgcgggtgctcaagatggtggagccctggctgagctccaagccggagttctgcatcaaggtcctgaacccctacatgcccacggtgatcgaggagctggagaagctccagcgcaagcacgggggcaacctggtgcggtgccccctgagccgcaactccacccacgagatgtactgggtcagcggcgcctccgggaacatcgtgagctccgtcaacaccaccagcaagatgctcctgaaccggttcacgacccgccaccggaagccgacctacgagaaggacgtggacctgggcgccgggacccgctccgtgagcacggagaccgagaagcccgacatgaccatcatcggccggcgcctccagcggctgcaggaggagcacaaggagacctggcactacgaccaggagaacccctaccgcacgtgggcgtaccacgggtcctacgaggccccgagcaccggctccgccagctccatggtcaacggcgtggtgaagctgctcaccaagccctgggacgtcatccccatggtgacccagctggccatgacggacaccacccccttcgggcagcagcgggtgttcaaggagaaggtcgacacccgcacgccgcagcccaagcccggcacccggatggtgatgaccaccacggccaactggctgtgggcgctcctggggaagaagaagaacccccgcctgtgcacccgggaggagttcatcagcaaggtgcgctccaacgccgccatcggcgccgtcttccaggaggagcaggggtggaccagcgccagcgaggcggtgaacgactcccggttctgggagctcgtggacaaggagcgcgccctgcaccaggagggcaagtgcgagagctgcgtctacaacatgatgggcaagcgcgagaagaagctgggggagttcggccgggccaaggggtcccgcgccatctggtacatgtggctcggcgcccggttcctggagttcgaggcgctggggttcctcaacgaggaccactggttcggccgcgagaacagctggtccggcgtggagggggagggcctgcaccggctggggtacatcctcgaggagatcgacaagaaggacggcgacctgatgtacgccgacgacaccgccggctgggacacgcgcatcaccgaggacgacctgcagaacgaggagctcatcaccgagcagatggccccgcaccacaagatcctggcgaaggccatcttcaagctgacctaccagaacaaggtggtcaaggtgctccggcccacgccccgcggggccgtgatggacatcatcagccggaaggaccagcgcggctccgggcaggtcggcacctacgggctgaacaccttcaccaacatggaggtgcagctgatccggcagatggaggccgagggcgtgatcacccaggacgacatgcagaaccccaagggcctcaaggagcgcgtcgagaagtggctgcgggagtgcggggtggaccgcctgaagcggatggccatcagcggcgacgactgcgtggtcaagccgctcgacgagcgcttcgggacgtccctgctgttcctcaacgacatgggcaaggtgcggaaggacatcccccagtgggagcccagcaaggggtggaagaactggcaggaggtgcccttctgctcccaccacttccacaagatcttcatgaaggacggccgcagcctggtcgtgccgtgccggaaccaggacgagctgatcggccgcgcgcgcatctcccagggggccggctggagcctccgggagaccgcctgcctggggaaggcctacgcccagatgtggtccctgatgtacttccaccgccgggacctccgcctggcgagcatggccatctgctccgccgtgcccaccgagtggttccccaccagccggacgacctggagcatccacgcccaccaccagtggatgaccaccgaggacatgctgaaggtctggaaccgcgtgtggatcgaggacaaccccaacatgatcgacaagacgccggtgcactcctgggaggacatcccctacctcggcaagcgggaggacctgtggtgcgggagcctgatcggcctctccagccgcgccacctgggcgaagaacatccacaccgccatcacccaggtccggaacctgatcggcaaggaggagtacgtggactacatgcccgtgatgaagcgctactccgcccccagcgagtccgagggggtcctgtga

SEQ ID NO: 10528 - RNA, 9867 nt, synthetic construct
  misc_feature 1..9867: note = derived and/or modified CDS sequence (opt1) from DENV-4__JQ513339__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggcgaccttcaaggtcccgcacgccaagcggcaggacgtgaccctgctggggtcccaggagggcgccatgcacagcgccctcgccggcgcgaccgaggtggacagcggggacgagaaccacatgttcgccggccacctgaagtgcaaggtccgcatggggaagctgcgcatcaagggcatgtcctacacgatgtgcagcggcaagttctccatcgacaaggagatggccgagacccagcacgggaccaccgtggtgaaggtcaagtacgagggcgccggggccccctgcaaggtgcccatcgagatccgggacgtgaacaaggagaaggtcgtgggccgcgtgctcagcgcgacgcccctggccgagaacaccaactccgtcaccaacatcgagctggagccgcccttcggggacagctacatcgtgatcggcgtgggcaactccgccctcaccctgcactggttcacgaaggggagctccatcggcaagatgttcgagagcacctaccggggggccaagcgcatggcgatcctgggcgagaccgcctgggacttcgggtccgtcggcggcctcttcaccagcctggggaaggccgtgcaccaggtgttcggctccgtctacacgaccatgttcgggggcgtgagctggatgatccggatcctgatcgggttcctggtgctctggatcggcaccaactcccgcaacaccagcatggccatgacgtgcatcgccgtcggcgggatcaccctgttcctgggcttcaccgtgcaggcggacatggggtgcgtggtctcctggagcggccgggagctcaagtgcgggtccggcatcttcgtggtggacaacgtccacacctggacggagcagtacaagttccagcccgagagccccgcccgcctggccagcgccatcctgaacgcccacaaggacggcgtgtgcgggatccggtccaccacccgcctcgagaacgtgatgtggaagcagatcaccaacgagctgaactacgtcctgtgggagggcgggcacgacctcacggtggtggcgggcgacgtcaagggcgtgctgaccaaggggaagcgggccctgaccccgcccgccagcgacctcaagtactcctggaagacctggggcaaggccaagatcttcacgcccgaggcccgcaacagcaccttcctgatcgacgggcccgacacctccgagtgcccgaacgagcggcgcgcgtggaacagcttcgaggtggaggactacggcttcgggatgttcaccacgaacatctggatgaagttccgggagggctccagcgaggtctgcgaccaccgcctgatgtccgccgccatcaaggaccagaaggccgtgcacgcggacatgggctactggatcgagagctccaagaaccagacctggcagatcgagcgggccagcctcatcgaggtgaagacctgcctgtggcccaagacccacaccctgtggtccaacggggtcctcgagagccagatgctgatccccaagtcctacgccggcccgttcagccagcacaactaccgccaggggtacgccacgcagaccgtgggcccctggcacctggggaagctcgagatcgacttcggcgagtgccccggcaccaccgtgacgatccaggagaactgcgaccaccgggggccctccctgcgcaccaccaccgccagcggcaagctggtcacgcagtggtgctgccgcagctgcaccatgccgcccctccggttcctgggggaggacggctgctggtacgggatggagatccgccccctgtccgagaaggaggagaacatggtgaagagccaggtgaccgcgggccagggcacctccgagacgttcagcatggggctcctgtgcctgaccctcttcgtcgaggagtgcctgcggcgccgggtgacccgcaagcacatgatcctggccgtcgtgatcaccctctgcgccatcatcctgggcgggctgacgtggatggacctcctgcgggccctgatcatgctcggcgacaccatgtccggccgcatcgggggccagacccacctggccatcatggcggtgttcaagatgagccccgggtacgtcctgggcgtgttcctccggaagctgacctcccgcgagacggccctgatggtgatcgggatggccatgaccaccaccctcagcatcccgcacgacctgatggagctgatcgacggcatctccctcggcctgatcctgctcaagatcgtcacgcagttcgacaacacccaggtggggaccctggccctgagcctcaccttcatccggtccacgatgagcctggtgatggcctggcgcaccatcatggcggtcctgttcgtggtgaccctcatccccctgtgccggacctcctgcctgcagaagcagagccactgggtcgagatcacggccctcatcctgggcgcccaggccctgcccgtgtacctcatgaccctgatgaagggggcgtcccgccggagctggcccctgaacgagggcatcatggccgtggggctcgtctccctgctgggcagcgccctcctgaagaacgacgtgccgctggccggccccatggtggccgggggcctcctgctggcggcctacgtcatgtccgggagcagcgccgacctctccctggagaaggccgccaacgtgcagtgggacgagatggcggacatcaccggcagctcccccatcatcgaggtgaagcaggacgaggacgggagcttctccatccgcgacgtcgaggagaccaacatgatcacgctgctcgtgaagctggccctgatcaccgtgagcggcctctaccccctggccatcccgatcaccatgaccctgtggtacatgtggcaggtcaagacccagcggtccggcgccctctgggacgtgcccagccccgccgcgacgcagaaggccgccctgtccgagggggtgtaccgcatcatgcagcggggcctgttcgggaagacccaggtcggcgtggggatccacatggagggcgtgttccacaccatgtggcacgtcacccgcggcagcgtgatctgccacgagacggggcggctcgagccctcctgggccgacgtgcgcaacgacatgatcagctacggcgggggctggcgcctgggcgacaagtgggacaaggaggaggacgtccaggtgctggccatcgagccggggaagaaccccaagcacgtgcagaccaagcccggcctcttcaagaccctgaccggggagatcggcgcggtcacgctggacttcaagcccgggacctccggcagcccgatcatcaaccggaagggcaaggtgatcgggctctacggcaacggggtggtcaccaagtccggcgactacgtgagcgccatcacccaggccgagcgcatcggggagcccgactacgaggtggacgaggacatcttccggaagaagcgcctgacgatcatggacctgcaccccggcgccggcaagaccaagcggatcctgccgtccatcgtccgcgaggcgctcaagcggcgcctgcggaccctgatcctcgcccccacccgcgtggtggccgccgagatggaggaggccctgcgggggctgcccatccgctaccagacgcccgcggtcaagagcgagcacaccggccgggagatcgtggacctcatgtgccacgccaccttcaccacgcgcctgctgtccagcacccgggtgccgaactacaacctcatcgtcatggacgaggcccacttcaccgaccccagctccgtggccgcccgcgggtacatcagcacccgggtggagatgggcgaggcggccgccatcttcatgacggccaccccccccggggccaccgacccgttcccccagtccaacagccccatcgaggacatcgagcgcgagatccccgagcggtcctggaacaccggcttcgactggatcacggactaccagggcaagaccgtctggttcgtgccgagcatcaaggcggggaacgacatcgccaactgcctgcgcaagtccggcaagaaggtcatccagctgagccgcaagaccttcgacaccgagtaccccaagacgaagctcaccgactgggacttcgtggtgaccaccgacatctccgagatgggggccaacttccgggccggccgcgtcatcgacccccggcgctgcctgaagcccgtgatcctgacggacgggccggagcgggtgatcctcgcgggccccatccccgtcacccccgccagcgccgcccagcgccggggccgcatcgggcggaacccggcccaggaggacgaccagtacgtgttctccggcgaccccctgaagaacgacgaggaccacgcgcactggaccgaggccaagatgctgctcgacaacatctacacccccgaggggatcatccccacgctgttcggcccggagcgcgagaagacccaggccatcgacggcgagttccggctgcgcggggagcagcggaagaccttcgtggagctcatgcgccggggcgacctgcccgtctggctgagctacaaggtggcctccgccgggatcagctacaaggaccgcgagtggtgcttcaccggcgagcggaacaaccagatcctcgaggagaacatggaggtggagatctggacccgcgagggggagaagaagaagctgcggcccaagtggctggacgcgcgcgtctacgccgaccccatggccctcaaggacttcaaggagttcgcctccggccggaagagcatcacgctggacatcctgaccgagatcgcctccctcccgacctacctgagctcccgcgcgaagctggccctcgacaacatcgtgatgctgcacaccacggagcgcggcgggcgggcctaccagcacgccctgaacgagctccccgagagcctggagaccctgatgctcgtggcgctgctgggcgccatgaccgccgggatcttcctcttcttcatgcagggcaaggggatcggcaagctgagcatgggcctgatcaccatcgccgtcgcctccgggctcctgtgggtggcggagatccagccccagtggatcgccgccagcatcatcctggagttcttcctcatggtgctgctgatcccggagcccgagaagcagcgcacgccccaggacaaccagctcatctacgtcatcctgaccatcctgaccatcatcggcctcatcgccgccaacgagatggggctgatcgagaagaccaagacggacttcggcttctaccaggtgaagaccgagaccaccatcctggacgtggacctccggcccgcgtccgcctggacgctgtacgccgtcgccaccaccatcctgaccccgatgctccgccacacgatcgagaacaccagcgccaacctgtccctggcggccatcgccaaccaggccgccgtgctcatggggctgggcaagggctggcccctgcaccggatggacctcggggtgcccctgctggcgatgggctgctacagccaggtcaaccccaccaccctcacggcctccctggtgatgctgctcgtgcactacgccatcatcgggccgggcctgcaggccaaggcgacccgcgaggcccagaagcggaccgccgccggcatcatgaagaaccccaccgtcgacgggatcacggtgatcgacctggagcccatcagctacgaccccaagttcgagaagcagctcggccaggtgatgctgctggtcctctgcgccgggcagctgctgctcatgcgcaccacctgggcgttctgcgaggtgctgaccctggccacgggcccgatcctcaccctgtgggaggggaaccccggccggttctggaacaccaccatcgccgtgtccacggccaacatcttccgcggcagctacctggccggggcgggcctcgccttctccctgatcaagaacgcccagaccccccggcgcgggaccggcaccaccggggagacgctgggcgagaagtggaagcggcagctcaacagcctggaccgcaaggagttcgaggagtacaagcggtccggcatcctggaggtcgaccgcaccgaggccaagagcgccctcaaggacgggtccaagatcaagcacgcggtgagccggggctccagcaagatccgctggatcgtggagcgggggatggtcaagcccaagggcaaggtgatcgacctggggtgcggccgcggcgggtggtcctactacatggccaccctgaagaacgtgaccgaggtcaagggctacacgaaggggggcccggggcacgaggagcccatccccatggccacctacggctggaacctcgtgaagctgcacagcggcgtggacgtcttctacaagcccaccgagcaggtggacaccctgctctgcgacatcggggagagctccagcaacccgacgatcgaggagggccgcaccctgcgggtgctgaagatggtcgagccctggctgtccagcaagcccgagttctgcatcaaggtgctcaacccctacatgccgaccgtgatcgaggagctggagaagctgcagcgcaagcacgggggcaacctcgtccggtgccccctgtcccgcaacagcacccacgagatgtactgggtgtccggcgccagcgggaacatcgtgtccagcgtcaacacgacctccaagatgctgctcaaccggttcaccacccgccaccggaagcccacgtacgagaaggacgtggacctgggcgcggggacccgcagcgtctccaccgagaccgagaagcccgacatgacgatcatcggccggcgcctgcagcggctccaggaggagcacaaggagacctggcactacgaccaggagaacccgtaccgcacctgggcctaccacgggagctacgaggccccctccaccggcagcgcctccagcatggtgaacggcgtggtcaagctgctgacgaagccctgggacgtgatcccgatggtgacccagctcgccatgaccgacaccacgcccttcgggcagcagcgggtcttcaaggagaaggtggacacccgcaccccccagcccaagccgggcacccggatggtgatgacgaccaccgcgaactggctgtgggccctgctcgggaagaagaagaacccccgcctgtgcacccgggaggagttcatctccaaggtccgcagcaacgccgccatcggcgccgtgttccaggaggagcaggggtggacgagcgcgtccgaggccgtgaacgacagccggttctgggagctggtcgacaaggagcgcgccctccaccaggagggcaagtgcgagtcctgcgtgtacaacatgatgggcaagcgggagaagaagctgggggagttcggccgcgccaaggggagccgcgccatctggtacatgtggctgggcgcgcggttcctcgagttcgaggccctggggttcctgaacgaggaccactggttcggccgcgagaactcctggagcggcgtggagggggagggcctccaccggctggggtacatcctggaggagatcgacaagaaggacggcgacctcatgtacgccgacgacaccgccggctgggacacccgcatcaccgaggacgacctgcagaacgaggagctgatcaccgagcagatggcgccccaccacaagatcctcgccaaggccatcttcaagctgacgtaccagaacaaggtcgtgaaggtgctgcggcccaccccgcgcggggccgtcatggacatcatctcccggaaggaccagcgcggcagcgggcaggtgggcacctacgggctcaacaccttcacgaacatggaggtgcagctgatccggcagatggaggccgagggcgtcatcacccaggacgacatgcagaaccccaagggcctgaaggagcgcgtggagaagtggctccgggagtgcggggtggaccgcctgaagcggatggcgatctccggcgacgactgcgtcgtgaagcccctggacgagcgcttcgggaccagcctcctgttcctgaacgacatgggcaaggtgcggaaggacatcccccagtgggagccgtccaaggggtggaagaactggcaggaggtccccttctgcagccaccacttccacaagatcttcatgaaggacggccgctccctcgtggtgccctgccggaaccaggacgagctgatcggccgcgcccggatcagccagggggccggctggtccctgcgcgagaccgcctgcctcgggaaggcctacgcgcagatgtggagcctgatgtacttccaccgccgggacctgcgcctcgcctccatggccatctgcagcgccgtccccacggagtggttcccgaccagccggaccacctggtccatccacgcccaccaccagtggatgacgaccgaggacatgctgaaggtgtggaaccgcgtgtggatcgaggacaaccccaacatgatcgacaagacccccgtccacagctgggaggacatcccctacctgggcaagcgggaggacctctggtgcgggtccctgatcggcctgagctcccgcgcgacctgggccaagaacatccacacggccatcacccaggtgcggaacctcatcggcaaggaggagtacgtggactacatgccggtcatgaagcgctacagcgccccctccgagagcgagggggtgctgtga

SEQ ID NO: 10529 - RNA, 9867 nt, synthetic construct
  misc_feature 1..9867: note = derived and/or modified CDS sequence (opt1) from DENV-4__JQ513343__SS-prME
  source 1..9867: mol_type = other RNA
agcaccatcaccctgctctgcctgatccccacggtgatggccttccacctgtccacccgcgacggcgagcccctcatgatcgtggccaagcacgagcgggggcgccccctgctgttcaagaccaccgagggcatcaacaagtgcacgctcatcgccatggacctgggggagatgtgcgaggacaccgtgacctacaagtgccccctgctcgtgaacaccgagcccgaggacatcgactgctggtgcaacctgacgagcacctgggtgatgtacgggacgtgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggagaccttcaaggtcccgcacgcgaagcggcaggacgtgaccctgctggggtcccaggagggcgccatgcacagcgccctcgccggcgccaccgaggtggacagcggggacgagaaccacatgttcgcgggccacctgaagtgcaaggtccgcatggagaagctgcgcatcaaggggatgtcctacacgatgtgcagcggcaagttctccatcgacaaggagatggccgagacccagcacggcaccaccgtggtgaaggtcaagtacgagggggccggcgccccctgcaaggtgcccatcgagatccgggacgtgaacaaggagaaggtcgtggggcgcgtgatcagcgccacgcccctcgcggagaacaccaactccgtcaccaacatcgagctggagccgcccttcggcgacagctacatcgtgatcggggtgggcaactccgccctgaccctccactggttccggaagggcagctccatcgggaagatgttcgagagcacgtaccgcggcgccaagcggatggccatcctgggggagaccgcgtgggacttcggctccgtcgggggcctgttcaccagcctcggcaaggccgtgcaccaggtgttcgggtccgtctacaccacgatgttcggcggggtgagctggatgatccgcatcctgatcggcttcctggtgctgtggatcgggaccaactcccggaacaccagcatggccatgacctgcatcgccgtcggcggcatcaccctcttcctggggttcaccgtgcaggccgacatgggctgcgtggtctcctggagcgggcgcgagctgaagtgcggctccgggatcttcgtggtggacaacgtccacacctggaccgagcagtacaagttccagcccgagagccccgcgcggctcgccagcgccatcctgaacgcccacaaggacggcgtgtgcggcatccgctccacgacccggctggagaacgtgatgtggaagcagatcaccaacgagctcaactacgtcctgtgggagggcgggcacgacctgaccgtggtggccggggacgtcaagggcgtgctcacgaagggcaagcgcgcgctgaccccgcccgccagcgacctgaagtactcctggaagacctgggggaaggccaagatcttcacccccgaggcccggaacagcacgttcctcatcgacggccccgacacctccgagtgcccgaacgagcgccgggcctggaacagcttcgaggtggaggactacgggttcggcatgttcaccaccaacatctggatgaagttccgcgaggggtccagcgaggtctgcgaccaccggctgatgtccgcggccatcaaggaccagaaggccgtgcacgccgacatgggctactggatcgagagctccaagaaccagacgtggcagatcgagcgcgcgagcctgatcgaggtgaagacctgcctctggcccaagacccacaccctgtggtccaacggcgtcctggagagccagatgctcatccccaagtcctacgccgggccgttcagccagcacaactaccggcagggctacgccacccagacggtggggccctggcacctgggcaagctggagatcgacttcggggagtgccccggcaccaccgtgaccatccaggagaactgcgaccaccgcggcccctccctccgcacgaccaccgccagcgggaagctggtcacccagtggtgctgccggagctgcacgatgccgcccctgcgcttcctcggcgaggacgggtgctggtacggcatggagatccggcccctgtccgagaaggaggagaacatggtcaagagccaggtgaccgccgggcagggcacctccgagaccttcagcatgggcctgctctgcctgacgctgttcgtcgaggagtgcctccgccggcgcgtgacccggaagcacatgatcctggcggtcgtgatcaccctgtgcgccatcatcctcgggggcctgacctggatggacctgctccgcgccctgatcatgctgggggacacgatgtccggccggatcggcgggcagacccacctcgccatcatggccgtgttcaagatgagccccggctacgtcctgggggtgttcctgcgcaagctcacctcccgggagaccgcgctgatggtgatcggcatggccatgacgaccaccctgagcatcccgcacgacctcatggagctgatcgacgggatctccctgggcctcatcctgctgaagatcgtcacccagttcgacaacacccaggtgggcaccctcgccctgagcctgaccttcatccgctccaccatgagcctcgtgatggcctggcggacgatcatggccgtcctgttcgtggtgaccctgatccccctctgccgcacctcctgcctgcagaagcagagccactgggtcgagatcaccgcgctgatcctcggggcccaggccctgcccgtgtacctgatgacgctcatgaagggcgcctcccggcgcagctggcccctgaacgaggggatcatggcggtgggcctggtctccctcctggggagcgccctgctcaagaacgacgtgccgctggccggccccatggtggccggcgggctgctcctggccgcgtacgtcatgtccggcagcagcgccgacctgtccctcgagaaggccgccaacgtgcagtgggacgagatggccgacatcaccgggagctcccccatcatcgaggtgaagcaggacgaggacggcagcttctccatccgggacgtcgaggagaccaacatgatcaccctgctggtgaagctcgcgctgatcacggtgagcgggctgtaccccctcgccatcccgatcaccatgaccctgtggtacatgtggcaggtcaagacccagcgctccggcgccctgtgggacgtgcccagccccgccgccacccagaaggcggccctctccgagggcgtgtaccggatcatgcagcgcgggctgttcggcaagacgcaggtcggggtgggcatccacatggagggggtgttccacaccatgtggcacgtcacccggggcagcgtgatctgccacgagaccggccgcctggagccctcctgggccgacgtgcgcaacgacatgatcagctacgggggcgggtggcggctcggcgacaagtgggacaaggaggaggacgtccaggtgctggccatcgagccgggcaagaaccccaagcacgtgcagacgaagcccgggctgttcaagaccctcaccggcgagatcggggccgtcaccctggacttcaagcccggcacgtccgggagcccgatcatcaaccgcaagggcaaggtgatcggcctgtacgggaacggcgtggtcaccaagtccggggactacgtgagcgcgatcacccaggccgagcggatcggcgagcccgactacgaggtggacgaggacatcttccgcaagaagcggctcaccatcatggacctgcaccccggggccggcaagacgaagcgcatcctgccgtccatcgtccgggaggccctgaagcgccggctccgcaccctgatcctggcgcccacccgggtggtggccgccgagatggaggaggccctccgcggcctgcccatccggtaccagacccccgccgtcaagagcgagcacacggggcgcgagatcgtggacctgatgtgccacgcgaccttcaccacccggctcctgtccagcacgcgcgtgccgaactacaacctgatcgtcatggacgaggcccacttcaccgaccccagctccgtggccgcccggggctacatcagcacccgcgtggagatgggggaggccgcggccatcttcatgaccgccacgccgcccggcgccaccgacccgttcccccagtccaacagccccatcgaggacatcgagcgggagatccccgagcgctcctggaacaccgggttcgactggatcaccgactaccagggcaagacggtctggttcgtgccgagcatcaaggccggcaacgacatcgcgaactgcctccgcaagtccgggaagaaggtcatccagctgagccggaagaccttcgacaccgagtaccccaagaccaagctgacggactgggacttcgtggtgaccaccgacatctccgagatgggcgccaacttccgcgccgggcgggtcatcgacccccgccggtgcctcaagcccgtgatcctgaccgacggcccggagcgcgtgatcctggccgggcccatccccgtcacgcccgcgagcgccgcccagcggcgcggccggatcggccgcaacccggcccaggaggacgaccagtacgtgttctccggggaccccctcaagaacgacgaggaccacgcccactggaccgaggcgaagatgctgctggacaacatctacacccccgagggcatcatccccaccctcttcgggccggagcgggagaagacgcaggccatcgacggcgagttccgcctgcggggcgagcagcgcaagaccttcgtggagctgatgcggcgcggggacctccccgtctggctgagctacaaggtggcctccgccggcatcagctacaaggaccgggagtggtgcttcaccggggagcgcaacaaccagatcctggaggagaacatggaggtggagatctggacccgggagggcgagaagaagaagctccgccccaagtggctggacgcccgggtctacgcggaccccatggccctgaaggacttcaaggagttcgcctccgggcgcaagagcatcaccctcgacatcctgacggagatcgcctccctgccgacctacctcagctcccgcgccaagctggcgctggacaacatcgtgatgctccacaccaccgagcggggcggccgcgcctaccagcacgccctgaacgagctgcccgagagcctcgagacgctgatgctggtggccctcctgggggcgatgaccgccggcatcttcctgttcttcatgcaggggaagggcatcgggaagctcagcatgggcctgatcaccatcgccgtcgcctccggcctgctctgggtggccgagatccagccccagtggatcgcggccagcatcatcctggagttcttcctgatggtgctcctgatcccggagcccgagaagcagcggacgccccaggacaaccagctgatctacgtcatcctcacgatcctgaccatcatcgggctgatcgccgccaacgagatgggcctcatcgagaagaccaagaccgacttcgggttctaccaggtgaagacggagaccaccatcctggacgtggacctgcgccccgcctccgcgtggaccctctacgccgtcgccacgaccatcctgaccccgatgctgcggcacaccatcgagaacacgagcgccaacctctccctggccgcgatcgccaaccaggccgccgtgctgatgggcctcgggaagggctggcccctgcaccgcatggacctgggcgtgcccctcctggccatggggtgctacagccaggtcaaccccaccaccctgaccgcgtccctcgtgatgctgctggtgcactacgccatcatcggcccggggctccaggccaaggccacgcgggaggcgcagaagcgcaccgccgccggcatcatgaagaaccccaccgtcgacggcatcaccgtgatcgacctggagcccatcagctacgaccccaagttcgagaagcagctgggccaggtgatgctcctggtcctgtgcgccggccagctcctgctgatgcggacgacctgggccttctgcgaggtgctcaccctggcgaccgggccgatcctgacgctctgggagggcaaccccgggcgcttctggaacaccaccatcgccgtgtccaccgccaacatcttccggggcagctacctggccggcgccgggctggcgttctccctcatcaagaacgcccagacgccccgccggggcaccgggaccaccggcgagaccctgggggagaagtggaagcgccagctgaacagcctcgaccggaaggagttcgaggagtacaagcgctccggcatcctggaggtcgaccggacggaggccaagagcgccctgaaggacggctccaagatcaagcacgccgtgagccgcgggtccagcaagatccggtggatcgtggagcgcggcatggtcaagcccaaggggaaggtgatcgacctcggctgcgggcgcggcggctggtcctactacatggcgaccctgaagaacgtgaccgaggtcaaggggtacaccaagggcgggccgggccacgaggagcccatccccatggccacgtacgggtggaacctggtgaagctccacagcggcgtggacgtcttctacaagcccaccgagcaggtcgacaccctgctgtgcgacatcggcgagagctccagcaacccgaccatcgaggaggggcggacgctccgcgtgctgaagatggtcgagccctggctgtccagcaagcccgagttctgcatcaaggtgctgaacccctacatgccgaccgtgatcgaggagctcgagaagctgcagcggaagcacggcgggaacctggtccgctgccccctctcccggaacagcacccacgagatgtactgggtgtccggcgccagcggcaacatcgtgtccagcgtcaacaccacgtccaagatgctgctgaaccgcttcaccacccggcaccgcaagcccacctacgagaaggacgtggacctcggggccggcacgcggagcgtctccaccgagaccgagaagcccgacatgaccatcatcgggcgccggctgcagcgcctgcaggaggagcacaaggagacgtggcactacgaccaggagaacccgtaccggacctgggcgtaccacggcagctacgaggccccctccaccgggagcgcctccagcatggtgaacggcgtggtcaagctcctgaccaagccctgggacgtgatcccgatggtgacgcagctggccatgaccgacaccacccccttcggccagcagcgcgtcttcaaggagaaggtggacacgcggacgccccagcccaagccggggacccgcatggtgatgaccacgaccgccaactggctctgggcgctgctgggcaagaagaagaacccccggctctgcacccgcgaggagttcatctccaaggtccggagcaacgccgccatcggggccgtgttccaggaggagcagggctggaccagcgcctccgaggcggtgaacgacagccgcttctgggagctggtcgacaaggagcgggccctgcaccaggaggggaagtgcgagtcctgcgtgtacaacatgatgggcaagcgcgagaagaagctcggcgagttcgggcgcgccaagggcagccgggccatctggtacatgtggctgggggcccgcttcctggagttcgaggcgctcggcttcctgaacgaggaccactggttcgggcgggagaactcctggagcggcgtggagggcgaggggctgcaccgcctcggctacatcctggaggagatcgacaagaaggacggggacctgatgtacgccgacgacacggccggctgggacacccggatcaccgaggacgacctccagaacgaggagctgatcaccgagcagatggcgccccaccacaagatcctggcgaaggccatcttcaagctcacctaccagaacaaggtcgtgaaggtgctgcgccccacgccgcggggcgccgtcatggacatcatctcccgcaaggaccagcgggggagcggccaggtggggacctacggcctgaacaccttcaccaacatggaggtgcagctcatccgccagatggaggccgagggggtcatcacgcaggacgacatgcagaaccccaagggcctgaaggagcgggtggagaagtggctgcgcgagtgcggcgtggaccggctcaagcgcatggccatctccggggacgactgcgtcgtgaagcccctggacgagcggttcggcaccagcctcctgttcctgaacgacatggggaaggtgcgcaaggacatcccccagtgggagccgtccaagggctggaagaactggcaggaggtccccttctgcagccaccacttccacaagatcttcatgaaggacgggcggtccctggtggtgccctgccgcaaccaggacgagctcatcggccgggcgcgcatcagccagggcgccgggtggtccctgcgcgagaccgcctgcctgggcaaggcctacgcccagatgtggagcctcatgtacttccaccggcgcgacctgcggctggcgtccatggccatctgcagcgccgtccccaccgagtggttcccgacgagccgcaccacctggtccatccacgcccaccaccagtggatgaccacggaggacatgctcaaggtgtggaaccgggtgtggatcgaggacaaccccaacatgatcgacaagacccccgtccacagctgggaggacatcccctacctggggaagcgcgaggacctgtggtgcggctccctcatcgggctgagctcccgggccacctgggcgaagaacatccacaccgccatcacccaggtgcgcaacctgatcggcaaggaggagtacgtggactacatgccggtcatgaagcggtacagcgccccctccgagagcgagggcgtgctctga

SEQ ID NO: 10530 - RNA, 9867 nt, synthetic construct
  misc_feature 1..9867: note = derived and/or modified CDS sequence (opt1) from DENV-4__KT276273__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggccggcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggacgtggtcgaccgcggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccggagcccctccgtggaggtcgagctgccggactacggcgagctgaccctcgactgcgagccccgcagcgggatcgacttcaacgagatgatcctgatgaagatgaacaagaagacctggctggtgcacaagcagtggttcctcgacctgcccctgccctggaccgccggcgcggacacctccgaggtgcactggaacaacaaggagcggatggtcacgttcaaggtgccgcacgccaagcgccaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccggatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgcgacgtgaacaaggagaaggtgatcggccgggtcatctccagcatccccctggcggagaacaccaactccgtgacgaacatcgagctggagccgcccttcggggacagctacatcgtgatcggcgtcggcaactccgccctcaccctgcactggttccgcaaggggagctccatcggcaagatgttcgagagcacctaccggggggccaagcgcatggccatcctgggcgagaccgcgtgggacttcgggtccgtgggcggcctcttcacgagcctggggaaggccgtgcaccaggtcttcggctccgtgtacaccaccatgttcgggggcgtgagctggatgatccggatcctgatcgggttcctcgtcctgtggatcggcaccaactcccgcaacacgagcatggccatgacctgcatcgccgtgggcgggatcaccctgttcctgggcttcaccgtgcaggccgacatggggtgcgtcgtgtcctggagcggccgggagctcaagtgcgggagcggcatcttcgtgatcgacaacgtccacacgtggaccgagcagtacaagttccagcccgagtcccccgcgcgcctggccagcgccatcctgaacgcccacaaggacggcgtgtgcgggatccggtccaccacccgcctcgagaacgtgatgtggaagcagatcacgaacgagctgaactacgtcctgtgggagggcgggcacgacctcaccgtggtggccggcgacgtcaagggcgtgctgaccaaggggaagcgggcgctgaccccgcccgccagcgacctcaagtactcctggaagacgtggggcaaggccaagatcttcacccccgaggcccgcaacagcaccttcctgatcgacgggcccgacacctccgagtgcccgaacgagcggcgcgcctggaacagcctggaggtggaggactacggcttcgggatgttcacgaccaacatctggatgaagttccgggagggctccagcgagatgtgcgaccaccgcctcatgtccgcggccatcaaggaccagaaggccgtccacgccgacatgggctactggatcgagagctccaagaaccagacctggcagatcgagaaggcgagcctgatcgaggtgaagacctgcctgtggcccaagacgcacaccctctggtccaacggggtgctggagagccagatgctgatccccaagtcctacgccggcccgttcagccagcacaactaccggcaggggtacgccacccagatcgccggcccctggcacctcgggaagctggagatcgacttcggcgagtgccccggcaccaccgtcacgatccaggaggactgcgaccaccgcgggcccagcctgcgcaccaccaccgcctccggcaagctcgtgacgcagtggtgctgccggagctgcaccatgccgcccctgcgcttcctgggggaggacggctgctggtacgggatggagatccggcccctctccgagaaggaggagaacatggtgaagagccaggtcgcggccggccagggcacctccgagaccttcagcatggggctgctgtgcctcacgctgttcgtggaggagtgcctgcgccggcgcgtgacccggaagcacatgatcctcgtcgtggtcatcaccttctgcgccatcatcctgggcgggctgacctggatggacctcctgcgcgccctgatcatgctcggcgacacgatgtccggccggatcgggggccagatccacctggccatcatggcggtgttcaagatgagccccgggtacgtgctgggcgtcttcctccgcaagctgacctcccgggagaccgccctgatggtgatcgggatggccatgaccacggtgctcagcatcccgtacgacctgatggagctgatcgacggcatctccctcggcctgatcctgctcaagatcgtcacccagttcgacaacacccaggtggggaccctggccctgagcctcacgttcatccgctccaccatgcccctggtgatggcctggcggaccatcatggcggtcctgttcgtggtgaccctcatccccctgtgccgcacgagctgcctgcagaagcagtcccactgggtcgagatcaccgccctcatcctgggcgcccaggccctgcccgtgtacctcatgaccctgatgaagggggcgagccggcgctcctggccgctgaacgagggcatcatggccgtggggctcgtcagcctgctgggctccgccctcctgaagaacgacgtgcccctggccggccccatggtggccgggggcctcctgctggcggcctacgtcatgagcgggagctccgccgacctcagcctggagaaggccgccaacgtgcagtgggacgagatggcggacatcaccggctccagccccatcatcgaggtgaagcaggacgaggacgggtccttcagcatccgggacgtcgaggagacgaacatgatcaccctgctcgtgaagctggccctgatcaccgtgtccggcctctacccgctggccatccccgtcaccatgacgctgtggtacatgtggcaggtgaagacccagcgcagcggcgccctctgggacgtgccctcccccgccgcgacccagaaggccgccctgagcgagggggtctaccggatcatgcagcgcggcctgttcgggaagacccaggtgggcgtggggatccacatggagggcgtcttccacacgatgtggcacgtgacccggggctccgtgatctgccacgagaccgggcgcctcgagccgagctgggccgacgtccgcaacgacatgatctcctacggcgggggctggcggctgggcgacaagtgggacaaggaggaggacgtgcaggtgctggccatcgagcccgggaagaaccccaagcacgtccagaccaagcccggcctcttcaagaccctgacgggggagatcggcgcggtgaccctggacttcaagccggggaccagcggctcccccatcatcaaccgcaagggcaaggtgatcgggctctacggcaacggggtcgtgaccaagagcggcgactacgtgtccgccatcacgcaggccgagcggatcggggagcccgactacgaggtcgacgaggacatcttccgcaagaagcggctgaccatcatggacctgcacccgggcgccggcaagaccaagcgcatcctccccagcatcgtgcgggaggcgctgaagcgccggctgcgcaccctgatcctcgcccccacgcgggtggtcgccgccgagatggaggaggccctgcgcgggctgcccatccggtaccagaccccggcggtgaagtccgagcacaccggccgcgagatcgtggacctcatgtgccacgccaccttcacgacccggctgctgagcagcacccgcgtccccaactacaacctcatcgtgatggacgaggcccacttcaccgacccctccagcgtggccgcccgggggtacatctccacgcgcgtcgagatgggcgaggcggccgccatcttcatgaccgccacccccccgggggccaccgaccccttcccccagagcaactcccccatcgaggacatcgagcgggagatcccggagcgcagctggaacacgggcttcgactggatcaccgactaccagggcaagaccgtgtggttcgtcccctccatcaaggcggggaacgacatcgccaactgcctgcgcaagagcggcaagaaggtgatccagctgtcccggaagaccttcgacacggagtaccccaagaccaagctcaccgactgggacttcgtggtcaccacggacatcagcgagatgggggccaacttccgcgccggccgggtgatcgacccccgccggtgcctgaagccggtgatcctgaccgacgggcccgagcgcgtcatcctcgcgggccccatccccgtgaccccggcctccgccgcccagcggcgcggccggatcgggcgcaaccccgcccaggaggacgaccagtacgtgttcagcggcgaccccctgaagaacgacgaggaccacgcgcactggaccgaggccaagatgctgctcgacaacatctacacgcccgaggggatcatcccgaccctgttcggccccgagcgggagaagacccaggccatcgacggcgagttccgcctgcggggggagcagcgcaagaccttcgtcgagctcatgcggcgcggcgacctgcccgtgtggctgtcctacaaggtggccagcgccgggatctcctacaaggaccgggagtggtgcttcacgggcgagcgcaacaaccagatcctcgaggagaacatggaggtcgagatctggacccgggagggggagaagaagaagctgcgcccccggtggctggacgcgcgcgtgtacgccgacccgatggccctcaaggacttcaaggagttcgccagcggccgcaagtccatcaccctggacatcctgaccgagatcgccagcctccccacgtacctgtccagccgggcgaagctggccctcgacaacatcgtgatgctgcacaccaccgagcgcggcgggcgggcctaccagcacgccctgaacgagctccccgagagcctggagaccctgatgctcgtcgcgctgctgggcgccatgaccgccgggatcttcctcttcttcatgcagggcaaggggatcggcaagctgtccatgggcctgatcacgatcgccgtggccagcgggctcctgtgggtggcggagatccagccgcagtggatcgccgcctccatcatcctggagttcttcctcatggtcctgctgatccccgagcccgagaagcagcgcaccccccaggacaaccagctcatctacgtgatcctgaccatcctgaccatcatcggcctcatcgccgccaacgagatggggctgatcgagaagacgaagaccgacttcggcttctaccaggtgaagaccgagaccacgatcctggacgtcgacctccggccggcgagcgcctggaccctgtacgccgtggccaccaccatcctgacgcccatgctccgccacaccatcgagaacacctccgccaacctgagcctggcggccatcgccaaccaggccgccgtgctcatggggctgggcaagggctggcccctgcaccggatggacctcggggtccccctgctggcgatgggctgctactcccaggtgaacccgaccacgctcaccgccagcctggtgatgctgctcgtccactacgccatcatcgggcccggcctgcaggccaaggcgacccgcgaggcccagaagcggaccgccgccggcatcatgaagaaccccacggtggacgggatcaccgtgatcgacctggagcccatctcctacgacccgaagttcgagaagcagctcggccaggtcatgctgctggtgctctgcgccgggcagctgctgctcatgcgcaccacctgggcgttctgcgaggtgctgacgctggccaccggccccatcctcaccctgtgggaggggaaccccggccggttctggaacaccacgatcgccgtcagcaccgccaacatcttccgcggctcctacctggccggggcgggcctcgccttcagcctgatcaagaacgcccagaccccccggcgcgggaccggcacgaccggggagaccctgggcgagaagtggaagcggcagctcaactccctggaccgcaaggagttcgaggagtacaagcggagcggcatcctggaggtggaccgcaccgaggccaagtccgccctcaaggacgggagcaagatcaagcacgcggtgtcccggggcagctccaagatccgctggatcgtcgagcgcgggatggtgaagccgaagggcaaggtggtcgacctggggtgcggccggggcgggtggagctactacatggccacgctgaagaacgtgaccgaggtgaagggctacaccaaggggggccccgggcacgaggagcccatccccatggccacctacggctggaacctcgtcaagctgcacagcggcgtggacgtgttctacaagccgaccgagcaggtcgacacgctgctctgcgacatcggggagtccagctccaaccccaccatcgaggagggccgcaccctgcgggtgctgaagatggtggagccctggctcagctccaagcccgagttctgcatcaaggtcctgaacccgtacatgcccaccgtgatcgaggagctggagaagctgcagcgcaagcacgggggcaacctcgtgcggtgccccctgagccgcaactccacgcacgagatgtactgggtcagcggcgcctccgggaacatcgtgagctccgtcaacaccaccagcaagatgctgctcaaccggttcaccacgcgccaccggaagcccacctacgagaaggacgtggacctgggcgcggggacccgctccgtgagcaccgagacggagaagccggacatgaccatcatcggccggcgcctgcagcggctccaggaggagcacaaggagacctggcactacgaccaggagaacccctaccgcacctgggcctaccacgggtcctacgaggcccccagcacgggctccgccagctccatggtcaacggcgtggtgaagctgctgaccaagccgtgggacgtcatccccatggtgacccagctcgccatgaccgacacgacccccttcgggcagcagcgggtgttcaaggagaaggtcgacacccgcaccccccagccgaagcccggcacgcggatggtgatgaccaccaccgcgaactggctgtgggccctgctcgggaagaagaagaacccccgcctgtgcacgaaggaggagttcatcagcaaggtgcgggccaacgccgccatcggcgcggtcttccaggaggagcaggggtggaccagcgcctccgaggccgtgaacgacagccgcttctgggagctggtggacaaggagcgggccctccaccaggagggcaagtgcgagtcctgcgtctacaacatgatgggcaagcgcgagaagaagctgggggagttcggccgcgccaaggggagccgggcgatctggtacatgtggctgggcgcccgcttcctcgagttcgaggccctggggttcctgaacgaggaccactggttcggccgggagaactcctggagcggcgtggagggggagggcctccaccgcctggggtacatcctggaggagatcgacaagaaggacggcgacctcatgtacgccgacgacaccgcgggctgggacacccggatcacggaggacgacctgcagaacgaggagctgatcaccgagcagatggccccccaccacaagatcctcgccaaggccatcttcaagctgacctaccagaacaaggtggtcaaggtgctgcgcccgaccccccggggggccgtgatggacatcatctcccgcaaggaccagcggggcagcgggcaggtcggcacgtacgggctcaacaccttcaccaacatggaggtgcagctgatccgccagatggaggcggagggcgtgatcacccaggacgacatgcagaaccccaagggcctgaaggagcgggtcgagaagtggctccgcgagtgcggggtggaccggctgaagcgcatggccatctccggcgacgactgcgtggtcaagcccctggacgagcggttcgccaccagcctcctgttcctgaacgacatggggaaggtgcgcaaggacatcccgcagtgggagccctccaagggctggaagaactggcaggaggtgcccttctgcagccaccacttccacaagatcttcatgaaggacgggcggtccctcgtcgtgccctgccgcaaccaggacgagctgatcggccgggcccgcatcagccagggcgccgggtggtccctgaaggagacggcgtgcctcgccaaggcctacgcccagatgtggagcctgatgtacttccaccgccgggacctgcgcctcgcctccatggcgatctgcagcgccgtgccgaccgagtggttccccaccagccggaccacgtggtccatccacgcccaccaccagtggatgaccaccgaggacatgctgaaggtctggaaccgcgtgtggatcgaggacaaccccaacatgatcgacaagacccccgtgcacagctgggaggacatcccgtacctgggcaagcgggaggacctctggtgcgggtccctgatcggcctgagctcccgcgccacgtgggccaagaacatccacaccgcgatcacccaggtccggaacctcatcgggaaggaggagtacatggactacatgcccgtgatgcgccggtacagcgccccctccgagagcgagggcgtgctgtga

SEQ ID NO: 10531 - RNA, 9867 nt, synthetic construct
  misc_feature 1..9867: note = derived and/or modified CDS sequence (opt1) from DENV-4__KU523872__SS-prME
  source 1..9867: mol_type = other RNA
agcaccatgaccctgctctgcctgatccccaccgtgatggccttccacctgagcacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtcatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcccacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcatcatctccagcacccccttcgcggagaacacgaactccgtgaccaacatcgagctggagccgcccttcggggacagctacatcgtgatcggcgtcggcgactccgccctgaccctccactggttccggaaggggagctccatcggcaagatgttcgagagcacctaccgcggggccaagcggatggccatcctgggcgagacggcgtgggacttcgggtccgtgggcggcctgttcaccagcctcgggaaggccgtgcaccaggtcttcggctccgtgtacaccaccatgttcgggggcgtgagctggatgatccgcatcctgatcgggttcctggtcctctggatcggcacgaactcccggaacaccagcatggccatgacctgcatcgccgtgggcgggatcaccctgttcctgggcttcacggtgcaggccgacatggggtgcgtcgtgtcctggaacggcaaggagctgaagtgcgggaacggcatcttcgtggtcgacaacgtgcacacctggaccgagcagtacaagttccagcccgagagccccgcgcgcctcgccagcgccatcctgaacgcccacaaggacggcgtgtgcgggatccggtccaccacgcgcctggagaacgtcatgtggaagcagatcaccaacgagctcaactacgtgctgtgggagggcgggcacgacctgaccgtggtcgccggcgacgtgaagggcgtgctcaccaaggggaagcgggcgctgacgccgcccgtcaacgacctgaagtacagctggaagacctggggcaaggccaagatcttcacccccgaggcccgcaactccaccttcctcatcgacgggcccgacacgagcgagtgcccgaacgagcggcgcgcctggaacttcttcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctgatcgaggtgaagacgtgcctctggcccaagacccacaccctgtggtccaacggggtgctggagagccagatgctcatcccccggtcctacgcgggcccgttcagccagcacaactaccgccaggggtacgccacccagaccgccggcccctggcacctggggaagctggagatcgacttcggcgagtgccccggcacgaccgtcaccatccaggaggactgcgaccaccgggggccctccctccgcaccacgaccgccagcggcaagctggtgacccagtggtgctgccgctcctgcaccatgccgcccctgcggttcctcggggaggacggctgctggtacgggatggagatccgccccctgagcgagaaggaggagaacatggtcaagagccaggtcacggccggccagggcacctccgagaccttcagcatggggctgctctgcctgaccctgttcgtggaggagtgcctccggcgccgggtcacgcgcaagcacatgatcctggtggtggtcatcaccttctgcgcgatcatcctgggcgggctcacctgggtggacctgctgcgggccctcatcatgctgggcgacaccatgtccggccgcatcgggggccagatccacctggccatcatggccgtgttcaagatgagccccgggtacgtcctcggcgtgttcctgcggaagctgacgtcccgcgagaccgccctcatggtgatcgggatggcgatgaccaccgtcttcagcatcccgcacgacctgatggagctgatcgacggcatctccctcggcctgatcctgctcaagatcgtgacgcacttcgacaacacccaggtggggaccctggccctgagcctcaccttcatccggtccacgacgcccctggtcatggcctggcgcaccatcatggccgtgttcttcgtggtcaccctgatccccctctgccggacgagctgcctgcagaagcagtcccactgggtggagatcaccgccctgatcctcggcgcgcaggccctgcccgtgtacctgatgaccctcatgaagggggccagccgccggtcctggccgctgaacgagggcatcatggccgtcgggctggtgagcctcctgggctccgcgctgctcaagaacgacgtgcccctggccggccccatggtcgccgggggcctgctcctggccgcctacgtgatgagcgggtccagcgcggacctgtccctcgagaaggccgccaacgtgcagtgggacgagatggccgacatcaccggcagcagccccgtcatcgaggtgaagcaggacgaggacgggtccttcagcatccgcgacgtggaggagacgaacatgatcaccctgctggtcaagctcgccctgatcaccgtgtccggcctgtacccgctcgcgatccccgtgaccatggccatctggtacatctggcaggtcaagacgcagcggagcggcgccctgtgggacgtgccctcccccgccgccacccagaaggcgaccctgagcgagggggtgtaccgcatcatgcagcggggcctcttcgggaagacccaggtcggcgtggggatccacatggagggcgtgttccacaccatgtggcacgtcacgcgcggctccgtgatctgccacgagaccgggcggctggagccgagctgggccgacgtgcgcaacgacatgatctcctacggcgggggctggaagctgggcgacaagtgggacaaggaggaggacgtccaggtgctcgccatcgagcccgggaagaaccccaagcacgtgcagaccaagcccggcctgttcaagaccctgacgggggagatcggcgccgtcaccctcgacttcaagccggggaccagcggctcccccatcatcaacaagaagggcaaggtgatcgggctgtacggcaacggggtggtcaccaagagcggcgactacgtgtccgccatcacgcaggcggagcgcatcggggagcccgactacgaggtggacgaggacatcttccggaagaagcgcctgaccatcatggacctccacccgggcgccggcaagaccaagcggatcctgcccagcatcgtccgcgaggccctgaagcggcgcctccggaccctgatcctggcccccacgcgcgtggtggcggccgagatggaggaggccctccgggggctgcccatccgctaccagaccccggccgtcaagtccgagcacaccggccgggagatcgtggacctgatgtgccacgccaccttcacgacccgcctgctcagctccacccgggtccccaactacaacctgatcgtgatggacgaggcgcacttcaccgacccctgcagcgtggccgcccgcgggtacatctccacgcgggtcgagatgggcgaggccgccgcgatcttcatgaccgccacgcccccggggagcatcgaccccttcccccagagcaactcccccatcgaggacatcgagcgcgagatcccggagcggagctggaacaccggcttcgactggatcacggactaccagggcaagaccgtgtggttcgtgccctccatcaaggccgggaacgacatcgccaactgcctgcgcaagagcggcaagcgggtcatccagctctcccgcaagaccttcgacaccgagtaccccaagacgaagctgaccgactgggacttcgtggtgaccaccgacatcagcgagatgggggccaacttccgcgcgggccgggtcatcgacccccgccggtgcctgaagccggtgatcctcacggacgggcccgagcgcgtgatcctggccggccccatccccgtcaccccggcctccgccgcgcagcggcgcggccggatcgggcgcaaccccgcccaggaggacgaccagtacgtgttcagcggcgaccccctgcggaacgacgaggaccacgcccactggaccgaggccaagatgctcctggacaacatctacacccccgaggggatcatcccgacgctgttcggccccgagcgcgagaagacccaggccatcgacggcgagttccggctccgcggggagcagcggaagaccttcgtggagctgatgcgccggggcgacctgcccgtctggctctcctacaaggtggcgagcgccgggatctcctacaaggaccgcgagtggtgcttcaccggcgagcggaacaaccagatcctggaggagaacatggaggtggagatctggacgcgcgagggggagaagaagaagctgcggcccaagtggctcgacgcccgcgtctacgccgacccgatggccctgaaggacttcaaggagttcgcgagcggccggaagtccatcaccctggacatcctcaccgagatcgccaccctgcccacctacctgagctccaaggccaagctcgccctggacaacatcgtgatgctgcacacgaccgagaagggcgggcgcgcctaccagcacgcgctcaacgagctgcccgagagcctggagaccctcatgctggtggccctgctcggcgccatgaccgccgggatcttcctgttcttcatgcagggcaaggggatcggcaagctgtccatgggcctcatcgcgatcgccgtcgccagcgggctgctgtgggtggccgagatccagccgcagtggatcgccgcgtccatcatcctcgagttcttcctgatggtgctgctcatccccgagcccgagaagcagcgcacgccccaggacaaccagctgatctacgtcatcctgaccatcctcaccatcatcggcctggtggccgccaacgagatggggctgatcgagaagaccaagacggacttcggcttctaccaggtgaagaccgagaccaccatcctcgacgtcgacctgcggccggccagcgcctggacgctgtacgcggtggccaccaccatcctcacccccatgctgcgccacacgatcgagaacaccagcgccaacctgtccctcgccgccatcgcgaaccaggccgccgtgctgatggggctgggcaagggctggcccctccaccggatggacctgggggtccccctgctcgccatcggctgctacagccaggtgaacccgaccaccctgacggcctccctggtgatgctcctggtccactacgcgatcatcgggcccggcctgcaggccaaggccacccgcgaggcccagaagcggaccgcggccggcatcatgaagaaccccaccgtggacgggatcacggtgatcgacctcgagcccatcagctacgacccgaagttcgagaagcagctgggccaggtcatgctgctcgtgctgtgcgtggggcagctgctcctgatgcgcaccacctgggccctgtgcgaggtcctcaccctggccacgggccccatcatgaccctgtgggaggggaaccccggccggttctggaacaccaccatcgccgtgtccacggcgaacatcttccgcggcagctacctcgccggggccggcctggccttctccctgatcaagaacgcccagacgccccggcgcgggaccggcaccacgggggagaccctcggcgagaagtggaagcggcagctgaacagcctggaccgcaaggagttcgaggagtacaagcggtccggcatcctcgaggtggaccgcaccgaggccaagagcgccctgcgggacgggtccaagaccaagcacgccgtcagccgcggctccagcaagatccggtggatcgtggagcgcgggatgatcaagccgaagggcaaggtggtcgacctggggtgcggccggggcgggtggtcctactacatggccaccctcaagaacgtgacggaggtgaagggctacaccaagggcggccccgggcacgaggagcccatccccatggccacctacggctggaacctggtcaagctgcacagcggcgtggacgtgttctacaagccgaccgagcaggtcgacacgctcctgtgcgacatcggggagtccagctccaaccccaccatcgaggagggcaagaccctgcgcgtgctcaagatggtcgagccctggctgagcagcaagcccgagttctgcatcaaggtgctgaacccgtacatgcccaccgtgatcgaggagctcgagaagctgcagcgccggcacgggggctccctggtccgctgccccctcagccggaactccacgcacgagatgtactgggtgagcggcgcgtccgggaacatcgtgagctccgtcaacaccatcagcaagatgctgctgaaccgcttcaccacccggtaccgcaagcccacgtacgagaaggacgtggacctgggcgccgggacccggtccgtgagcaccgagaccgagaagccggacatgacgatcatcggccgccggctccagcgcctgcgggaggagcacaaggagacctggcactacgaccaggagaacccctaccgcacctgggcctaccacgggtcctacgaggcccccagcaccggctccgcgagctccatggtcaacggcgtggtgaagctgctcacgaagccgtgggacgtcgtgcccatggtgacccagctggccatgaccgacaccacgcccttcgggcagcagcgggtcttcaaggagaaggtggacacccgcacgccccagccgaagcccggcacccggaagatcatgacgaccaccgccaactggctgtgggccctcctggggaagaagaagtccccgcgcctgtgcacccgggaggagttcatctccaaggtgcgcagcaacgccgcgatcggcgccgtcttccaggaggagcaggggtggacgtccgccagcgaggccgtgaacgacagccggttctgggagctcgtggacaaggagcgcgccctgcaccaggagggccggtgcgagtcctgcgtctacaacatgatgggcaagcgcgagaagaagctgggggagttcggccgcgcgaaggggagccgggccatctggtacatgtggctcggcgcccgcttcctggagttcgaggccctggggttcctcaacgaggaccactggttctcccgggagaacagctggtccggcgtggagggcgaggggctgcaccgcctgggctacatcctcgaggacatcgacaagaaggacggggacctgatctacgccgacgacaccgcgggctgggacacccggatcaccgaggacgacctgctcaacgaggagctgatcacggagcagatggcgccccaccacaagaccctggccaaggccatcttcaagctcacctaccagaacaaggtggtcaaggtgctgcgccccacccccaagggcgcggtgatggacatcatcagccggaaggaccagcgcgggtccggccaggtcgggacctacggcctgaacacgttcaccaacatggaggtgcagctcatccggcagatggaggccgagggggtgatcacccaggacgacatgcagaaccccgagggcctgaaggagcgcgtcgagaagtggctgaaggagtgcggcgtggaccggctcaagcgcatggccatcagcggggacgactgcgtggtcaagcccctggacgagcggttctccaccagcctcctgttcctgaacgacatgggcaaggtgcgcaaggacatcccgcagtgggagccctccaaggggtggaagaactggcaggaggtgcccttctgcagccaccacttccacaagatcttcatgaaggacggccggtccctggtcgtgccctgccgcaaccaggacgagctcatcgggcgggcccgcatcagccagggcgccggctggtccctgcgggagacggcgtgcctggggaaggcctacgcccagatgtggagcctcatgtacttccaccgccgcgacctgcggctggcctccatggccatctgcagcgcggtgccgaccgagtggttccccaccagccgcaccacgtggtccatccacgcccaccaccagtggatgaccaccgaggacatgctcaaggtctggaaccgggtgtggatcgaggacaaccccaacatgaccgacaagacgcccgtgcacagctgggaggacatcccgtacctgggcaagcgcgaggacctgtggtgcgggtccctcatcggcctgagctcccgggccacctgggccaagaacatccacaccgccatcacccaggtccgcaacctgatcgggaaggaggagtacgtggactacatgcccgcgatgaagcggtacagcgcccccttcgagtccgagggcgtgctctga

SEQ ID NO: 10532 - RNA, 9867 nt, synthetic construct
  misc_feature 1..9867: note = derived and/or modified CDS sequence (opt1) from DENV-4__KP140942__SS-prME
  source 1..9867: mol_type = other RNA
agcaccatcaccctgctctgcctgatccccacggtgatggccttccacctgtccacccgggacggcgagcccctcatgatcgtggccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtgttcttcgtgctgatgatgctggtggccccctcctacggcatgcggtgcgtgggcgtggggaaccgcgacttcgtggagggcgtgagcgggggcgcgtgggtggacctcgtgctggagcacggcgggtgcgtcaccaccatggcccagggccggcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggacgtggtcgaccgcggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccggagcccctccgtggaggtcgagctgccggactacggcgagctgaccctcgactgcgagccccgcagcgggatcgacttcaacgagatgatcctgatgaagatgaacaagaagacctggctggtgcacaagcagtggttcctcgacctgcccctgccctggaccgccggcgcggacacctccgaggtgcactggaacaacaaggagcggatggtcacgttcaaggtgccgcacgccaagcgccaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccggatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgcgacgtgaacaaggagaaggtgatcggccgggtcatctccagcatccccctggcggagaacaccaactccgtgacgaacatcgagctggagccgcccttcggggacagctacatcgtgatcggcgtcggcaactccgccctcaccctgcactggttccgcaaggggagctccatcggcaagatgttcgagagcacctaccgcggggccaagcgcatggccatcctgggcgagaccgcgtgggacttcgggtccgtgggcggcctcttcacgagcctggggaaggccgtgcaccaggtcttcggctccgtgtacaccaccatgttcgggggcgtgagctggatgatccggatcctgatcgggttcctcgtcctgtggatcggcaccaactcccgcaacacgagcatggccatgacctgcatcgccgtgggcgggatcaccctgttcctgggcttcaccgtgcaggccgacatggggtgcgtcgtgtcctggagcggccgggagctcaagtgcgggagcggcatcttcgtgatcgacaacgtccacacgtggaccgagcagtacaagttccagcccgagtcccccgcgcgcctggccagcgccatcctgaacgcccacaaggacggcgtgtgcgggatccggtccaccacccgcctcgagaacgtgatgtggaagcagatcacgaacgagctgaactacgtcctgtgggagggcgggcacgacctcaccgtggtggccggcgacgtcaagggcgtgctgaccaaggggaagcgggcgctgaccccgcccgccagcgacctcaagtactcctggaagacgtggggcaaggccaagatcttcacccccgaggcccgcaacagcaccttcctgatcgacgggcccgacacctccgagtgcccgaacgagcggcgcgcctggaacagcctggaggtggaggactacggcttcgggatgttcacgaccaacatctggatgaagttccgggagggctccagcgagatgtgcgaccaccgcctcatgtccgcggccatcaaggaccagaaggccgtccacgccgacatgggctactggatcgagagctccaagaaccagacctggcagatcgagaaggcgagcctgatcgaggtgaagacctgcctgtggcccaagacgcacaccctctggtccaacggggtgctggagagccagatgctgatccccaagtcctacgccggcccgttcagccagcacaactaccggcaggggtacgccacccagatcgccggcccctggcacctcgggaagctggagatcgacttcggcgagtgccccggcaccaccgtcacgatccaggaggactgcgaccaccgcgggcccagcctgcgcaccaccaccgcctccggcaagctcgtgacgcagtggtgctgccggagctgcaccatgccgcccctgcgcttcctgggggaggacggctgctggtacgggatggagatccggcccctctccgagaaggaggagaacatggtcaagagccaggtcgcggccggccagggcacctccgagaccttcagcatggggctgctgtgcctcacgctgttcgtggaggagtgcctgcgccggcgcgtgacccggaagcacatgatcctcgccgtcgtgatcaccctgtgcgccatcatcctgggcgggctcacctggatggacctgctgcgcgccctcatcatgctgggcgacacgatgtccggccggatgggcgggcagacccacctggcgatcatggccgtcttcaagatgagccccgggtacgtgctcggcgtgttcctgcgcaagctgacctcccgggagaccgccctcatggtcatcgggatggccatgacgaccaccctgagcatcccgcacgacctgatggagctcatcgacggcatctccctgggcctgatcctcctgaagatcgtgacccagttcgacaacacccaggtggggaccctggccctcagcctgaccttcatccgctccaccatgagcctggtcatggcgtggcggacgatcatggccgtcctcttcgtggtcaccctgatccccctgtgccgcacctcctgcctccagaagcagagccactgggtggagatcaccgccctgatcctgggcgcccaggcgctccccgtgtacctgatgacgctgatgaagggggcctccaagcggagctggcccctcaacgagggcatcatggccgtcgggctggtgtccctgctcggcagcgccctgctgaagaacgacgtgccgctcgccggccccatggtcgccggcgggctgctgctcgccgcctacgtgatgagcgggtccagcgccgacctgtccctggagaaggccgcgaacgtgcagtgggacgagatggccgacatcaccgggagctcccccatcatcgaggtcaagcaggacgaggacgggagcttctccatccgcgacgtggaggagaccaacatgatcaccctcctggtgaagctggccctcatcacggtcagcggcctgtaccccctggccatcccggtgaccatgaccctctggtacatgtggcaggtcaagacccagcggtccggcgccctgtgggacgtccccagccccgcggccacgcagaaggccgccctgtccgagggggtgtaccgcatcatgcagcggggcctcttcgggaagacccaggtgggcgtcgggatccacatggagggcgtgttccacaccatgtggcacgtgacccgcggcagcgtcatctgccacgagaccgggcggctggagccctcctgggccgacgtgcgcaacgacatgatcagctacggcgggggctggcgcctgggcgacaagtgggacaaggaggaggacgtgcaggtcctcgcgatcgagccggggaagaaccccaagcacgtgcagacgaagcccggcctgttcaagaccctgaccggggagatcggcgccgtgaccctcgacttcaagcccgggacgtccggcagcccgatcatcaaccggaagggcaaggtcatcgggctgtacggcaacggggtggtgaccaagtccggcgactacgtcagcgccatcacccaggccgagcgcatcggggagcccgactacgaggtggacgaggacatcttccggaagaagcgcctgaccatcatggacctccaccccggcgcgggcaagacgaagcggatcctgccgtccatcgtgcgcgaggccctgaagcggcgcctgcggaccctcatcctggcccccacccgcgtcgtggccgccgagatggaggaggcgctgcgggggctccccatccgctaccagacccccgccgtcaagagcgagcacacgggccgggagatcgtcgacctgatgtgccacgccaccttcaccacccgcctgctcagctccacgcgggtgccgaactacaacctgatcgtgatggacgaggcccacttcaccgaccccagctccgtcgccgcgcgcgggtacatcagcacccgggtggagatgggcgaggccgccgccatcttcatgaccgccacgccgcccggggcgaccgacccgttcccccagtccaacagccccatcgaggacatcgagcgcgagatccccgagcggtcctggaacaccggcttcgactggatcaccgactaccagggcaagacggtgtggttcgtcccgagcatcaaggccgggaacgacatcgccaactgcctgcgcaagtccggcaagaaggtgatccagctcagccgcaagaccttcgacaccgagtaccccaagaccaagctgacggactgggacttcgtcgtgaccaccgacatctccgagatgggggccaacttccgggcgggccgcgtgatcgacccccggcgctgcctgaagcccgtcatcctcaccgacgggccggagcgggtgatcctggccggccccatccccgtgacgcccgccagcgccgcccagcgccggggccgcatcgggcggaacccggcgcaggaggacgaccagtacgtcttctccggcgaccccctgaagaacgacgaggaccacgcccactggaccgaggccaagatgctcctggacaacatctacacccccgaggggatcatccccaccctgttcggcccggagcgcgagaagacgcaggccatcgacggcgagttccggctccgcggggagcagcggaagaccttcgtggagctgatgcgccggggcgacctgcccgtgtggctcagctacaaggtcgcctccgcggggatcagctacaaggaccgcgagtggtgcttcaccggcgagcggaacaaccagatcctggaggagaacatggaggtggagatctggacccgcgagggggagaagaagaagctgcggccccgctggctcgacgcccgggtgtacgccgaccccatggccctgaaggacttcaaggagttcgcctccggccgcaagagcctgacgctcgacatcctgaccgagatcgcgtccctgccgacctacctcagcagccgcgccaagctggccctggacaacatcgtcatgctccacaccaccgagcggggcgggcgcgcctaccagcacgcgctgaacgagctgcccgagtccctcgagacgctgatgctggtggccctcctgggcgccatgaccgccgggatcttcctgttcttcatgcagggcaaggggatcggcaagctcagcatgggcctgatcaccatcgccgtggcgtccgggctgctctgggtcgccgagatccagccccagtggatcgccgccagcatcatcctggagttcttcctgatggtgctcctgatcccggagcccgagaagcagcggacgccccaggacaaccagctgatctacgtgatcctcacgatcctgaccatcatcggcctgatcgccgcgaacgagatggggctcatcgagaagaccaagaccgacttcggcttctaccaggtcaagacggagaccaccatcctggacgtggacctgcgccccgcctccgcctggaccctctacgccgtggccacgaccatcctgaccccgatgctgcggcacaccatcgagaacacgagcgcgaacctctccctggccgccatcgccaaccaggccgcggtcctgatggggctcggcaagggctggcccctgcaccgcatggacctgggggtgcccctcctggccatgggctgctacagccaggtgaaccccaccaccctgaccgcctccctcgtcatgctgctggtgcactacgccatcatcgggccgggcctccaggcgaaggccacgcgggaggcccagaagcgcaccgccgccggcatcatgaagaaccccaccgtggacgggatcaccgtcatcgacctggagcccatcagctacgaccccaagttcgagaagcagctgggccaggtgatgctcctggtgctgtgcgcggggcagctcctgctgatgcggacgacctgggccttctgcgaggtcctcaccctggccaccggcccgatcctgacgctctgggaggggaaccccggccgcttctggaacaccaccatcgccgtgtccaccgccaacatcttccggggcagctacctggcgggggccggcctggccttctccctcatcaagaacgcccagacgccccgccgggggaccggcaccaccggggagacgctgggcgagaagtggaagcgccagctgaacagcctcgaccggaaggagttcgaggagtacaagcgctccggcatcctggaggtggaccggaccgaggccaagagcgcgctgaaggacgggtccaagatcaagcacgccgtcagccgcggctccagcaagatccggtggatcgtggagcgcgggatggtgaagcccaagggcaaggtcgtggacctcgggtgcggccgcggcgggtggagctactacatggccaccctgaagaacgtgaccgaggtcaagggctacaccaagggcggcccggggcacgaggagcccatccccatggccacgtacggctggaacctggtgaagctccactccggcgtggacgtcttctacaagcccaccgagcaggtcgacaccctgctgtgcgacatcggggagagctccagcaacccgaccatcgaggagggccggacgctccgcgtgctgaagatggtcgagccctggctgtccagcaagcccgagttctgcatcaaggtgctgaacccctacatgccgaccgtgatcgaggagctcgagaagctgcagcggaagcacgggggcaacctggtccgctgccccctctcccggaacagcacccacgagatgtactgggtgtccggcgcgagcgggaacatcgtgtccagcgtcaacaccacgtccaagatgctgctgaaccgcttcaccacccggcaccgcaagcccacctacgagaaggacgtggacctcggcgccgggacgcggagcgtctccaccgagaccgagaagcccgacatgaccatcatcggccgccggctgcagcgcctgcaggaggagcacaaggagacgtggcactacgaccaggagaacccgtaccggacctgggcctaccacgggagctacgaggccccctccaccggcagcgcctccagcatggtgaacggcgtggtcaagctcctgaccaagccctgggacgtgatcccgatggtgacgcagctggcgatgaccgacaccacccccttcgggcagcagcgcgtcttcaaggagaaggtggacacgcggacgccccagcccaagccgggcacccgcatggtgatgaccacgaccgccaactggctctgggccctgctggggaagaagaagaacccccggctctgcaccaaggaggagttcatcagcaaggtccgcgccaacgccgcgatcggcgccgtgttccaggaggagcaggggtggacctccgccagcgaggccgtgaacgactcccggttctgggagctggtcgacaaggagcgcgccctgcaccaggagggcaagtgcgagagctgcgtgtacaacatgatgggcaagcgggagaagaagctcggggagttcggccgcgcgaaggggtcccgcgccatctggtacatgtggctgggcgcccggttcctggagttcgaggccctcgggttcctgaacgaggaccactggttcggccgcgagaacagctggtccggcgtggagggggagggcctgcaccggctcgggtacatcctggaggagatcgacaagaaggacggcgacctgatgtacgcggacgacacggccggctgggacacccgcatcaccgaggacgacctccagaacgaggagctgatcaccgagcagatggcgccccaccacaagatcctggccaaggccatcttcaagctcacgtaccagaacaaggtcgtgaaggtgctgcggcccaccccgcgcggggcggtcatggacatcatcagccggaaggaccagcgcggctccggccaggtgggcacctacgggctgaacaccttcaccaacatggaggtgcagctcatccggcagatggaggccgagggcgtcatcacgcaggacgacatgcagaaccccaagggcctgaaggagcgcgtggagaagtggctgcgggagtgcggggtggaccgcctcaagcggatggccatcagcggcgacgactgcgtcgtgaagcccctggacgagcgcttcgccacctccctcctgttcctgaacgacatggggaaggtgcggaaggacatcccccagtgggagccgagcaagggctggaagaactggcaggaggtccccttctgctcccaccacttccacaagatcttcatgaaggacgggcgcagcctggtggtgccctgccggaaccaggacgagctcatcggccgcgcccggatctcccagggcgcggggtggagcctgaaggagaccgcctgcctggccaaggcctacgcccagatgtggtccctcatgtacttccaccgccgcgacctgcggctggcgagcatggccatctgcagcgccgtccccaccgagtggttcccgacgtcccgcaccacctggagcatccacgcccaccaccagtggatgaccacggaggacatgctcaaggtgtggaaccgggtgtggatcgaggacaaccccaacatgatcgacaagacccccgtccactcctgggaggacatcccctacctgggcaagcgcgaggacctgtggtgcgggagcctcatcggcctgtccagccgggccacctgggcgaagaacatccacaccgccatcacccaggtgcgcaacctgatcgggaaggaggagtacatggactacatgccggtgatgcggcgctactccgcccccagcgagtccgagggcgtcctctga

SEQ ID NO: 10533 - RNA, 9867 nt, synthetic construct
  misc_feature 1..9867: note = derived and/or modified CDS sequence (opt1) from DENV-4__KU523871__SS-prME
  source 1..9867: mol_type = other RNA
agcaccatgaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtcatgtacgggacctgcacccagaacggggagcggcgccgggagaagcgctccgtggccctgaccccgcacagcggcatgggcctcgagacccgggccgagacctggatgtccagcgagggggcctggaagcacgcccagcgcgtggagtcctggatcctgcggaaccccggcttcgcgctgctcgccgggttcatggcctacatgatcggccagaccgggatccagcgcatcgtcttcttcgtgctgatgatgctggtggcccccagctacggcatgcggtgcgtcggcgtggggaaccgcgacttcgtggagggcgtctccgggggcgcgtgggtggacctcgtgctggagcacggcgggtgcgtcaccaccatggcccagggcaagcccaccctggacttcgagctcaccaagacgaccgccaaggaggtggccctgctgcggacctactgcatcgaggccagcatctccaacatcaccacggcgacccgctgcccgacccagggggagccctacctcaaggaggagcaggaccagcagtacatctgccggcgcgacgtggtcgaccggggctgggggaacggctgcggcctgttcgggaagggcggggtggtgacctgcgccaagttcagctgctccggcaagatcacggggaacctggtccagatcgagaacctcgagtacaccgtggtggtcaccgtgcacaacggcgacacccacgccgtcggcaacgacacgagcaaccacggggtgaccgccaccatcacgccccgctcccccagcgtggaggtcaagctgccggactacggcgagctgacgctcgactgcgagccccggtccgggatcgacttcaacgagatgatcctgatgaagatgaagaagaagacctggctggtgcacaagcagtggttcctcgacctgcccctgccctggaccgccggcgcggacaccagcgaggtgcactggaaccacaaggagcgcatggtcaccttcaaggtgccgcacgccaagcggcaggacgtgacggtcctcgggtcccaggagggcgccatgcacagcgccctggccggcgcgaccgaggtggacagcggggacggcaaccacatgttcgccgggcacctgaagtgcaaggtgcgcatggagaagctccgcatcaagggcatgtcctacaccatgtgcagcggcaagttctccatcgacaaggagatggccgagacccagcacgggacgaccgtcgtgaaggtgaagtacgagggcgccggggccccctgcaaggtccccatcgagatccgggacgtgaacaaggagaaggtggtcggccgcatcatcagctccacccccttcgcggagaacaccaacagcgtgacgaacatcgagctggagccgcccttcggggactcctacatcgtgatcggcgtcggcgagagcgccctgaccctccactggttccggaaggggtccagcatcggcaagatgttcgagtccacctaccgcggggccaagcggatggccatcctgggcgagaccgcgtgggacttcgggagcgtgggcggcctgttcacgtccctcgggaaggccgtgcaccaggtcttcggcagcgtgtacaccaccatgttcgggggcgtgtcctggatggtccgcatcctgatcgggttcctggtgctctggatcggcaccaacagccggaacacgtccatggccatgacctgcatcgccgtgggcgggatcaccctgttcctgggcttcaccgtccaggccgacatggggtgcgtggtgagctggtccggcaaggagctgaagtgcgggagcggcatcttcgtcgtggacaacgtgcacacgtggaccgagcagtacaagttccagcccgagagccccgcgcgcctcgcctccgccatcctgaacgcccacaaggacggcgtctgcgggatccggagcaccacccgcctggagaacgtgatgtggaagcagatcacgaacgagctcaactacgtgctgtgggagggcgggcacgacctgaccgtcgtggccggcgacgtgaagggcgtcctcacccgggggaagcgcgcgctgaccccgcccgtgaacgacctgaagtactcctggaagacgtggggcaaggccaagatcttcacccccgaggcccggaacagcaccttcctcatcgacgggcccgacacctccgagtgcccgaacgagcgccgggcctggaacttcttcgaggtggaggactacggcttcgggatgttcacgaccaacatctggatgaagttccgcgagggcagctccgaggtctgcgaccaccggctgatgagcgccgcgatcaaggaccagaaggccgtgcacgccgacatgggctactggatcgagtccagcaagaaccagacctggcagatcgagaaggcctccctgatcgaggtgaagacctgcctctggcccaagacgcacaccctgtggagcaacggggtcctggagtcccagatgctcatcccccgcagctacgcgggcccgttctcccagcacaactaccggcaggggtacgccacccagaccgtgggcccctggcacctggggaagctggagatcgacttcggcgagtgccccggcaccacggtggccatccgcgaggactgcgaccaccgcgggcccagcctccggaccaccaccgcctccggcaagctggtcacgcagtggtgctgccgcagctgcaccatgccgcccctgcggttcctcggggaggacggctgctggtacgggatggagatccgccccctgagcgagaaggaggagaacatggtgaagtcccaggccaccgcgggccagggcaccagcgagacgttctccatggggctgctctgcctgaccctgttcgtcgaggagtgcctccggcgccgggtgacccgcaagcacatgatcctggtggtcgtgatcaccttctgcgccatcatcctgggcgggctcacgtggatggacctgctgcgggccctcatcatgctgggcgacaccatgagcggccgcatcgggggccagatccacctggccatcatggccgtgttcaagatgtcccccgggtacgtcctcggcgtgttcctgcggaagctgaccagccgcgagaccgcgctcatggtgatcgggatggccatgacgaccgtcttctccatcccgcacgacctgatggagctgatcgacggcatcagcctcggcctgatcctgctcaagatcgtgacccacttcgacaacacccaggtggggacgctggccctgtccctcaccttcctgcggagcaccacgcccctggtcatggcctggcgcacgatcatggccgtgttcttcgtggtcaccctcatccccctgtgccggacctcctgcctgcagaagcagagccactgggtggagatcaccgcgctcatcctgggcgcccaggccctgcccgtgtacctcatgacgctgatgaagggggcctcccgccggagctggccgctgaacgagggcatcatggcggtcgggctcgtgtccctgctgggcagcgccctcctgaagaacgacgtgcccctggccggccccatggtcgccgggggcctcctgctggccgcgtacgtgatgtccgggagctccgccgacctcagcctggagaaggccgccaacgtgcagtgggacgagatggccgacatcaccggcagctcccccatcatcgaggtcaagcaggacgaggacgggagcttctccatccgcgacgtggaggagaccaacatgatgaccctgctcgtgaagctggcgctgatcacggtcagcggcctctacccgctggccatccccgtgaccatggccctgtggtacatctggcaggtcaagacccagcggtccggcgccctctgggacgtccccagccccgccgcgacccagaaggccacgctgtccgagggggtgtaccgcatcatgcagcggggcctgttcgggaagacccaggtgggcgtcgggatccacatggagggcgtgttccacaccatgtggcacgtgacccgcggcagcgtcatctgccacgagaccgggcgcctcgagccgtcctgggccgacgtgcggaacgacatgatcagctacggcgggggctggcgcctgggcgacaagtgggacaaggaggaggacgtgcaggtcctggccatcgagcccgggaagaaccccaagcacgtgcagacgaagcccggcctcttcaagaccctgaccggggagatcggcgccgtgaccctggacttcaagccggggacgtccggcagccccatcatcaacaagaagggcaaggtcatcgggctctacggcaacggggtggtgaccaagtccggcgactacgtcagcgcgatcacccaggccgagcggatcggggagcccgactacgaggtggacgaggacatcttccgcaagaagcggctgaccatcatggacctgcacccgggcgccggcaagacgaagcgcatcctcccctccatcgtgcgggaggccctgaagcgccggctgcgcaccctcatcctggcgcccacccgggtcgtggccgccgagatggaggaggccctgcgcgggctgcccatccggtaccagaccccggccgtgaagtccgagcacacgggccgcgagatcgtcgacctcatgtgccacgcgaccttcaccacccggctgctgtccagcacgcgcgtgcccaactacaacctcatcgtcatggacgaggcccacttcaccgacccctgctccgtggccgcccgggggtacatcagcacccgcgtggagatgggcgaggccgcggccatcttcatgaccgccacgcccccgggggccaccgaccccttcccccagagcaactcccccatcgaggacatcgagcgggagatcccggagcgcagctggaacaccggcttcgactggatcaccgactaccagggcaagacggtctggttcgtgccctccatcaaggccgggaacgacatcgcgaactgcctgcgcaagagcggcaagcgggtgatccagctgtcccgcaagaccttcgacaccgagtaccccaagaccaagctcacggactgggacttcgtcgtgaccaccgacatcagcgagatgggggccaacttccgggccggccgcgtgatcgacccccggcgctgcctgaagccggtcatcctgaccgacgggcccgagcgggtgatcctcgccggccccatccccgtgacgccggcgtccgccgcccagcgccggggccgcatcgggcggaaccccgcccaggaggacgaccagtacgtcttcagcggcgaccccctgaagaacgacgaggaccacgcccactggaccgaggcgaagatgctgctcgacaacatctacacccccgaggggatcatcccgaccctgttcggccccgagcgcgagaagacgcaggccatcgacggcgagttccggctgcgcggggagcagcggaagaccttcgtggagctcatgaagcgcggcgacctgcccgtgtggctgtcctacaaggtcgccagcgccgggatctcctacaaggaccgggagtggtgcttcaccggcgagcgcaacaaccagatcctcgaggagaacatggaggtggagatctggaccaaggagggggagaagaagaagctgcggcccaagtggctggacgcccgcgtgtacgcggacccgatggccctcaaggacttcaaggagttcgccagcggccggaagtccatcacgctggacatcctgaccgagatcgccagcctccccacctacctgtccagcaaggccaagctggcgctcgacaacatcatcatgctgcacaccaccgagaagggcgggcgcgcctaccagcacgccctgaacgagctccccgagtccctggagacgctgatgctcgtcgccctgctgggcgcgatgaccgccgggatcttcctcttcttcatgcagggcaaggggatcggcaagctgagcatgggcctgatcgccatcgccgtggcctccgggctcctgtgggtggcggagatccagccgcagtggatcgccgccagcatcatcctggagttcttcctcatggtcctgctgatccccgagcccgagaagcagcgcacgccccaggacaaccagctcatctacgtgatcctgaccatcctgacgatcatcggcctcatcgccgccaacgagatggggctgatcgagaagaccaagaccgacttcggcttctaccaggtgaagaccgagacgaccatcctggacgtcgacctccggccggcgagcgcctggaccctgtacgccgtggccaccacgatcctgacccccatgctccgccacaccatcgagaacacctccgccaacctgagcctggcggccatcgccaaccaggccgccgtgctcatggggctgggcaagggctggcccctgcaccggatggacctcggggtccccctgctggcgatcggctgctactcccaggtgaacccgacgaccctcaccgccagcctggtgatgctgctcgtccactacgccatcatcgggcccggcctgcaggccaaggcgacccgcgaggcccagaagcggacggccgccggcatcatgaagaaccccaccgtggacgggatcaccgtgatcgacctggagcccatctcctacgacccgaagttcgagaagcagctcggccaggtcatgctgctggtgctctgcgccgggcagctgctgctcatgcgcaccacgtgggcgctgtgcgaggtgctgaccctcgccaccggccccgccatgaccctgtgggaggggaaccccggccggttctggaacacgaccatcgccgtcagcaccgccaacatcttccgcggctcctacctggcgggggccggcctcgccttcagcctgatcaagaacgcccagacgccccggcgcgggacgggcaccaccggggagaccctgggcgagaagtggaagcggcagctcaactccctggaccgcaaggagttcgaggagtacaagcggagcggcatcctggaggtggaccgcacggaggccaagtccgcgctcaaggacgggagcaagatcaagcacgccgtgtcccggggcagctccaagatccgctggatcgtcgagcgggggatggtgaagccgaagggcaaggtggtcgacctggggtgcggccgcggcgggtggagctactacatggccaccctgaagaacgtgaccgaggtgaagggctacaccaagggcggccccgggcacgaggagcccatccccatggccacctacggctggaacctcgtcaagctgcactccggcgtggacgtgttctacaagccgacggagcaggtcgacaccctgctctgcgacatcggggagagctccagcaaccccaccatcgaggagggccggaccctgcgcgtgctgaagatggtggagccctggctcagctccaagcccgagttctgcatcaaggtcctgaacccgtacatgcccacggtgatcgaggagctggagaagctccagcgccggcacgggggcagcctggtccgctgccccctgtcccggaacagcacccacgagatgtactgggtgtccggcgcgagcgggaacatcgtgtccagcgtcaacaccatctccaagatgctgctcaaccgcttcaccacgcggcaccgcaagcccacctacgagaaggacgtggacctgggcgccgggacccggagcgtgtccaccgagacggagaagccggacatgaccatcatcggccgccggctgcagcgcctccgggaggagcacaaggagacctggcactacgaccaggagaacccctaccgcacctgggcctaccacgggagctacgaggccccctccacgggcagcgcctccagcatggtcaacggcgtggtgaagctgctgaccaagccgtgggacgtcgtgcccatggtgacccagctcgcgatgaccgacacgacccccttcgggcagcagcgggtcttcaaggagaaggtggacacccgcacgccccagccgaagcccggcacgcggatgatcatgaccaccaccgccaactggctgtggacgctgctcgggaagaagaagtccccgcgcctgtgcacccgggaggagttcatcagcaaggtgcgcagcaacgccgccatcggcgccgtcttccaggaggagcaggggtggaccagcgcgagcgaggccgtgaacgactcccggttctgggagctggtggacaaggagcgcgccctccaccaggagggcaagtgcgagagctgcgtctacaacatgatgggcaagcgggagaagaagctgggggagttcggccgcgccaaggggtcccgcgccatgtggtacatgtggctgggcgcgcggttcctcgagttcgaggccctggggttcctgaacgaggaccactggttcagccgcgagaactcctggagcggcgtggagggcgaggggctccaccggctgggctacatcctggaggacatcgacaagaaggacggggacctcatctacgccgacgacaccgccggctgggacacgcgcatcaccgaggacgacctgctgaacgaggagctcatcaccgagcagatggcgccccaccacaagaccctggccaaggccatcttcaagctgacgtaccagaacaaggtggtcaaggtgctccggcccacccccaagggcgccgtgatggacatcatctcccgcaaggaccagcgggggagcggccaggtcgggacctacggcctgaacaccttcaccaacatggaggtgcagctgatccgccagatggaggccgagggggtgatcacgcaggacgacatgcagaaccccaagggcctcaaggagcgggtcgagaagtggctgaccgagtgcggcgtggaccgcctgaagcggatggcgatctccggggacgactgcgtggtcaagcccctcgacgagcgcttcagcacctccctgctgttcctcaacgacatgggcaaggtgcggaaggacatcccgcagtgggagcccagcaaggggtggaagaactggcaggaggtgcccttctgctcccaccacttccacaagatcttcatgaaggacggccgcagcctggtcgtgccctgccggaaccaggacgagctgatcgggcgcgcccggatctcccagggcgccggctggagcctccgcgagaccgcctgcctggggaaggcctacgcgcagatgtggtccctgatgtacttccaccggcgcgacctccgcctggccagcatggccatctgcagcgccgtgccgacggagtggttccccacctcccggaccacctggagcatccacgcccaccaccagtggatgacgaccgaggacatgctgaaggtctggaaccgcgtgtggatcgaggacaaccccaacatgaccgacaagacccccgtgtactcctgggaggacatcccgtacctcggcaagcgggaggacctgtggtgcgggagcctgatcggcctctccagccgcgcgacgtgggccaagaacatccacaccgccatcacccaggtccggaacctgatcgggaaggaggactacgtggactacatgcccatcatgaagcgctactccgcccccagcgagtccgagggcgtgctgtga

SEQ ID NO: 10534 - RNA, 9867 nt, synthetic construct
  misc_feature 1..9867: note = derived and/or modified CDS sequence (opt1) from DENV-4__HQ332175__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggccctcatctccaacatcacgaccgcgacccgctgcccgacccagggggagccctacctgaaggaggagcaggaccagcagtacatctgccggcgcgacgtggtcgaccggggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctcaccctggactgcgagccccggtccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcgcatggtcaccttcaaggtgccgcacgcgaagcggcaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcgcatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatcagcgccacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacgtaccgcggggccaagcggatggccatcctcggcgagaccgcgtgggacttcgggtccgtgggcggcctgttcaccagcctggggaaggccgtccaccaggtgttcggctccgtgtacaccacgatgttcgggggcgtcagctggatgatccgcatcctcatcgggttcctggtgctgtggatcggcaccaactcccggaacaccagcatggccatgacctgcatcgccgtgggcgggatcacgctgttcctcggcttcaccgtccaggccgacatggggtgcgtggtgtcctggagcggccgcgagctgaagtgcgggtccggcatcttcgtcgtggacaacgtgcacacctggaccgagcagtacaagttccagcccgagagccccgcgcggctggccagcgccatcctcaacgcccacaaggacggcgtctgcgggatccgctccacgacccggctggagaacgtgatgtggaagcagatcaccaacgagctgaactacgtgctctgggagggcgggcacgacctgaccgtcgtggccggcgacgtgaagggcgtcctgacgaaggggaagcgcgcgctcaccccgcccgccagcgacctgaagtactcctggaagacctggggcaaggccaagatcttcacccccgaggcccggaacagcacgttcctgatcgacgggcccgacacctccgagtgcccgaacgagcgccgggcctggaacagcttcgaggtggaggactacggcttcgggatgttcaccaccaacatctggatgaagttccgcgagggctccagcgaggtgtgcgaccaccggctcatgtccgcggccatcaaggaccagaaggccgtccacgccgacatgggctactggatcgagagctccaagaaccagacgtggcagatcgagcgcgcgagcctgatcgaggtgaagacctgcctgtggcccaagacccacaccctctggtccaacggggtgctggagagccagatgctgatccccaagtcctacgccggcccgttcagccagcacaactaccggcaggggtacgccacccagacggtcggcccctggcacctcgggaagctggagatcgacttcggcgagtgccccggcaccaccgtgaccatccaggagaactgcgaccaccgcgggccctccctgcgcacgaccaccgccagcggcaagctcgtgacccagtggtgctgccggagctgcacgatgccgcccctgcgcttcctgggggaggacggctgctggtacgggatggagatccggcccctctccgagaaggaggagaacatggtcaagagccaggtgaccgccggccagggcacctccgagaccttcagcatggggctgctgtgcctcacgctgttcgtcgaggagtgcctgcgccggcgcgtgacccggaagcacatgatcctcgcggtggtcatcaccctgtgcgccatcatcctgggcgggctcacctggatggacctgctgcgcgccctcatcatgctgggcgacacgatgtccggccggatcgggggccagacccacctggccatcatggccgtgttcaagatgagccccgggtacgtgctcggcgtcttcctgcgcaagctgacctcccgggagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccgctccaccatgagcctggtgatggcctggcggacgatcatggccgtgctcttcgtcgtgaccctgatccccctgtgccgcacctcctgcctccagaagcagagccactgggtggagatcaccgcgctgatcctgggcgcccaggccctccccgtctacctgatgacgctgatgaagggggcctcccggcgcagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgtcgacctgtccctggagaaggccgccaacgtgcagtgggacgagatggccgacatcaccggcagctcccccatcatcgaggtgaagcaggacgaggacgggagcttctccatccgggacgtcgaggagaccaacatgatcaccctcctggtgaagctggccctcatcacggtgagcggcctgtaccccctggcgatcccgatcaccatgaccctctggtacatgtggcaggtcaagacccagcgctccggcgccctgtgggacgtgcccagccccgccgccacccagaaggccgcgctgtccgagggggtgtaccggatcatgcagcgcggcctcttcgggaagacgcaggtcggcgtggggatccacatggagggcgtgttccacaccatgtggcacgtcacccggggcagcgtgatctgccacgagaccgggcgcctggagccctcctgggccgacgtgcgcaacgacatgatcagctacggcgggggctggcggctgggcgacaagtgggacaaggaggaggacgtccaggtgctcgccatcgagccggggaagaaccccaagcacgtgcagacgaagcccggcctgttcaagaccctgaccggggagatcggcgccgtcaccctcgacttcaagcccgggacgtccggcagcccgatcatcaaccgcaagggcaaggtgatcgggctgtacggcaacggggtggtcaccaagtccggcgactacgtgagcgccatcacccaggcggagcggatcggggagcccgactacgaggtggacgaggacatcttccgcaagaagcggctgaccatcatggacctccaccccggcgccggcaagacgaagcgcatcctgccgtccatcgtccgggaggccctgaagcgccggctgcgcaccctcatcctggcccccacccgggtggtggcggccgagatggaggaggccctgcgcgggctccccatccggtaccagacccccgccgtcaagagcgagcacacgggccgcgagatcgtggacctgatgtgccacgccaccttcaccacccggctgctctccagcacgcgcgtgccgaactacaacctgatcgtcatggacgaggcgcacttcaccgaccccagctccgtggccgcccgggggtacatcagcacccgcgtcgagatgggcgaggccgccgcgatcttcatgaccgccacgccccccggggccaccgacccgttcccccagtccaacagccccatcgaggacatcgagcgggagatccccgagcgctcctggaacaccggcttcgactggatcaccgactaccagggcaagacggtgtggttcgtgccgagcatcaaggccgggaacgacatcgccaactgcctgcgcaagtccggcaagaaggtcatccagctcagccggaagaccttcgacaccgagtaccccaagaccaagctgacggactgggacttcgtggtgaccaccgacatctccgagatgggggcgaacttccgcgccggccgggtcatcgacccccgccggtgcctgaagcccgtgatcctcaccgacgggccggagcgcgtgatcctggccggccccatccccgtcacgcccgccagcgcggcccagcggcgcggccggatcgggcgcaacccggcccaggaggacgaccagtacgtgttctccggcgaccccctgaagaacgacgaggaccacgcccactggaccgaggccaagatgctcctggacaacatctacacccccgaggggatcatccccaccctgttcggcccggagcgggagaagacgcaggcgatcgacggcgagttccgcctccggggggagcagcgcaagaccttcgtggagctgatgcggcgcggcgacctgcccgtctggctcagctacaaggtggcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtctacgccgaccccatggcgctgaaggacttcaaggagttcgcctccggccgcaagagcatcaccctggacatcctcacggagatcgcctccctgccgacctacctgagctcccgcgccaagctcgccctggacaacatcgtgatgctgcacaccaccgagcggggcgggcgcgcgtaccagcacgccctcaacgagctgcccgagagcctggagacgctcatgctggtggccctgctcggcgccatgaccgcggggatcttcctgttcttcatgcagggcaaggggatcggcaagctgagcatgggcctcatcaccatcgccgtcgcctccgggctgctgtgggtggccgagatccagccccagtggatcgccgcgagcatcatcctcgagttcttcctgatggtgctgctcatcccggagcccgagaagcagcggaccccccaggacaaccagctgatctacgtcatcctgacgatcctcaccatcatcggcctgatcgccgccaacgagatggggctgatcgagaagaccaagaccgacttcggcttctaccaggtgaagacggagaccaccatcctcgacgtggacctgcgccccgcctccgcctggaccctgtacgcggtcgccacgaccatcctcaccccgatgctgcggcacaccatcgagaacacgagcgccaacctgtccctcgccgccatcgcgaaccaggccgccgtgctgatggggctgggcaagggctggcccctccaccgcatggacctgggggtgcccctgctcgccatgggctgctacagccaggtcaaccccaccaccctgaccgcctccctggtgatgctcctggtgcactacgcgatcatcgggccgggcctgcaggccaaggccacgcgggaggcccagaagcgcaccgcggccggcatcatgaagaaccccaccgtcgacgggatcaccgtgatcgacctcgagcccatcagctacgaccccaagttcgagaagcagctgggccaggtgatgctgctcgtcctgtgcgccgggcagctgctcctgatgcggacgacctgggccttctgcgaggtgctgaccctcgccaccggcccgatcctgacgctgtgggaggggaaccccggccgcttctggaacaccaccatcgcggtgtccaccgccaacatcttccggggcagctacctcgccggggccggcctggccttctccctgatcaagaacgcgcagacgccccgccgggggaccggcaccaccggggagaccctcggcgagaagtggaagcgccagctgaacagcctggaccggaaggagttcgaggagtacaagcgctccggcatcctcgaggtcgaccggacggaggccaagagcgccctgaaggacgggtccaagatcaagcacgccgtgagccgcggctccagcaagatccggtggatcgtggagcgcgggatggtcaagcccaagggcaaggtggtggacctggggtgcggccgcggcgggtggtcctactacatggccaccctcaagaacgtcaccgaggtgaagggctacaccaaggggggcccggggcacgaggagcccatccccatggcgacgtacggctggaacctggtgaagctgcacagcggcgtcgacgtgttctacaagcccaccgagcaggtggacaccctcctgtgcgacatcggggagagctccagcaacccgaccatcgaggagggccggacgctgcgcgtcctcaagatggtggagccctggctgtccagcaagcccgagttctgcatcaaggtgctgaacccctacatgccgaccgtcatcgaggagctggagaagctccagcggaagcacgggggcaacctggtgcgctgccccctgtcccggaacagcacccacgagatgtactgggtctccggcgccagcgggaacatcgtgtccagcgtgaacaccacgtccaagatgctcctgaaccgcttcaccacccggcaccgcaagcccacctacgagaaggacgtcgacctgggcgccgggacgcggagcgtgtccaccgagaccgagaagcccgacatgaccatcatcggccgccggctccagcgcctgcaggaggagcacaaggagacgtggcactacgaccaggagaacccgtaccggacctgggcctaccacgggagctacgaggcgccctccaccggcagcgcctccagcatggtgaacggcgtcgtgaagctgctcaccaagccctgggacgtgatcccgatggtcacgcagctggccatgaccgacaccacccccttcgggcagcagcgcgtgttcaaggagaaggtggacacgcggaccccccagcccaagccgggcacccgcatggtcatgaccacgaccgccaactggctgtgggccctcctggggaagaagaagaacccccggctgtgcacccgcgaggagttcatctccaaggtgcggagcaacgcggccatcggcgccgtgttccaggaggagcaggggtggaccagcgcctccgaggccgtcaacgacagccgcttctgggagctcgtggacaaggagcgggcgctgcaccaggagggcaagtgcgagtcctgcgtgtacaacatgatgggcaagcgcgagaagaagctgggggagttcggccgcgccaaggggagccgggccatctggtacatgtggctcggcgcccgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgcggacgacacggccggctgggacacccggatcaccgaggacgacctgcagaacgaggagctcatcaccgagcagatggccccccaccacaagatcctggccaaggcgatcttcaagctgacctaccagaacaaggtggtgaaggtcctccgccccacgccgcggggggccgtgatggacatcatctcccgcaaggaccagcggggcagcgggcaggtgggcacctacgggctgaacaccttcaccaacatggaggtccagctgatccgccagatggaggccgagggcgtgatcacgcaggacgacatgcagaaccccaagggcctcaaggagcgggtggagaagtggctgcgcgagtgcggggtcgaccggctgaagcgcatggccatctccggcgacgactgcgtggtgaagcccctcgacgagcggttcgggaccagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggcgggctggtccctccgcgagaccgcctgcctggggaaggcctacgcccagatgtggagcctgatgtacttccaccggcgcgacctccggctggcctccatggcgatctgcagcgccgtgcccaccgagtggttcccgacgagccgcaccacctggtccatccacgcccaccaccagtggatgaccacggaggacatgctgaaggtgtggaaccgggtctggatcgaggacaaccccaacatgatcgacaagacccccgtgcacagctgggaggacatcccctacctcggcaagcgcgaggacctgtggtgcgggtccctgatcggcctcagctcccgggccacctgggccaagaacatccacaccgcgatcgcccaggtgcgcaacctgatcggcaaggaggagtacgtcgactacatgccggtgatgaagcggtacagcgccccctccgagagcgagggggtgctgtga

SEQ ID NO: 10535 - RNA, 9867 nt, synthetic construct
  misc_feature 1..9867: note = derived and/or modified CDS sequence (opt1) from DENV-4__HQ332172__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcgcctgggtcatgtacggcacctgcacccagtccggggagcggcgccgggagaagcgcagcgtggccctgaccccgcactccggcatgggcctcgagacgcgggccgagacctggatgagctccgagggggcctggaagcacgcgcagcgcgtggagagctggatcctgcggaaccccggcttcgccctgctcgccgggttcatggcctacatgatcggccagaccgggatccagcgcaccgtcttcttcgtgctgatgatgctggtggcgccctcctacggcatgcggtgcgtcggcgtggggaaccgcgacttcgtggagggcgtcagcgggggcgcctgggtggacctcgtgctggagcacggcgggtgcgtcacgaccatggcccagggcaagcccaccctggacttcgagctcaccaagacgaccgccaaggaggtggccctgctgcggacctactgcatcgaggcgctcatctccaacatcaccacggccacccgctgcccgacccagggggagccctacctgaaggaggagcaggaccagcagtacatctgccggcgcgacgtggtcgaccggggctgggggaacggctgcggcctgttcgggaagggcggggtggtgacctgcgccaagttcagctgctccggcaagatcacggggaacctcgtccagatcgagaacctggagtacaccgtggtggtcaccgtgcacaacggcgacacccacgccgtcggcaacgacacgagcaaccacggggtgaccgccaccatcaccccccgctcccccagcgtggaggtcaagctgccggactacggcgagctcacgctggactgcgagccccggtccgggatcgacttcaacgagatgatcctgatgaagatgaagaagaagacctggctcgtgcacaagcagtggttcctggacctgcccctcccctggaccaccggcgcggacaccagcgaggtgcactggaactacaaggagcgcatggtcacgttcaaggtgccgcacgccaagcggcaggacgtgaccgtcctggggtcccaggagggcgccatgcacagcgccctggccggcgcgaccgaggtggacagcggggacggcaaccacatgttcgccgggcacctcaagtgcaaggtgcgcatggagaagctgcgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatcagcgcgacccccctggccgagaacacgaactccgtgaccaacatcgagctcgagccgcccttcggggacagctacatcgtcatcggcgtgggcaactccgccctgaccctgcactggttccggaaggggagctccatcggcaagatgttcgagagcacctaccgcggggccaagcggatggcgatcctcggcgagacggcctgggacttcgggtccgtgggcggcctgttcaccagcctggggaaggccgtccaccaggtgttcggctccgtgtacaccaccatgttcgggggcgtcagctggatgatccgcatcctcatcgggttcctggtgctgtggatcggcacgaactcccggaacaccagcatggccatgacctgcatcgccgtgggcgggatcaccctgttcctcggcttcacggtccaggcggacatggggtgcgtggtgtcctggagcggccgcgagctgaagtgcgggtccggcatcttcgtcgtggacaacgtgcacacctggaccgagcagtacaagttccagcccgagagccccgcccggctggccagcgccatcctcaacgcccacaaggacggcgtctgcgggatccgctccaccacgcggctggagaacgtgatgtggaagcagatcaccaacgagctgaactacgtgctctgggagggcgggcacgacctgaccgtcgtggcgggcgacgtgaagggcgtcctgaccaaggggaagcgcgccctcacgccgcccgccagcgacctgaagtactcctggaagacctggggcaaggccaagatcttcacccccgaggcccggaacagcaccttcctgatcgacgggcccgacacgtccgagtgcccgaacgagcgccgggcgtggaacagcttcgaggtggaggactacggcttcgggatgttcaccaccaacatctggatgaagttccgcgagggctccagcgaggtgtgcgaccaccggctcatgtccgccgccatcaaggaccagaaggccgtccacgcggacatgggctactggatcgagagctccaagaaccagacctggcagatcgagcgcgccagcctgatcgaggtgaagacgtgcctgtggcccaagacccacaccctctggtccaacggggtgctggagagccagatgctgatccccaagtcctacgccggcccgttcagccagcacaactaccggcaggggtacgccacccagaccgtcggcccctggcacctcgggaagctggagatcgacttcggcgagtgccccggcacgaccgtgaccatccaggagaactgcgaccaccgcgggccctccctgcgcaccacgaccgccagcggcaagctcgtgacccagtggtgctgccggagctgcaccatgccgcccctgcgcttcctgggggaggacggctgctggtacgggatggagatccggcccctctccgagaaggaggagaacatggtcaagagccaggtgacggcgggccagggcacctccgagaccttcagcatggggctgctgtgcctcaccctgttcgtcgaggagtgcctgcgccggcgcgtgacgcggaagcacatgatcctcgccgtggtcatcaccctgtgcgccatcatcctgggcgggctcacctggatggacctgctgcgcgccctcatcatgctgggcgacaccatgtccggccggatcgggggccagacgcacctggccatcatggcggtgttcaagatgagccccgggtacgtgctcggcgtcttcctgcgcaagctgacctcccgggagaccgccctcatggtgatcgggatggccatgaccacgaccctgagcatcccgcacgacctgatggagctcatcgacggcatctccctgggcctgatcctcctgaagatcgtgacccagttcgacaacacccaggtcgggacgctggccctcagcctgaccttcatccgctccaccatgagcctggtgatggcctggcggaccatcatggcggtgctcttcgtcgtgacgctgatccccctgtgccgcacctcctgcctccagaagcagagccactgggtggagatcaccgccctgatcctgggcgcccaggccctccccgtctacctgatgaccctgatgaagggggcgtcccggcgcagctggcccctcaacgagggcatcatggccgtggggctggtgtccctgctcggcagcgccctgctgaagaacgacgtcccgctcgccggccccatggtggccgggggcctgctgctcgcggcctacgtgatgtccgggagcagcgccgacctgtccctggagaaggccgccaacgtccagtgggacgagatggcggacatcacgggcagctcccccatcatcgaggtgaagcaggacgaggacgggagcttctccatccgggacgtggaggagaccaacatgatcaccctcctggtcaagctggccctcatcaccgtgagcggcctgtaccccctggccatcccgatcacgatgaccctctggtacatgtggcaggtgaagacccagcgctccggcgccctgtgggacgtccccagccccaccgccacccagaaggcggccctgtccgagggggtgtaccggatcatgcagcgcggcctcttcgggaagacgcaggtgggcgtcgggatccacatggagggcgtgttccacaccatgtggcacgtgacccggggcagcgtcatctgccacgagaccgggcgcctggagccctcctgggccgacgtgcgcaacgacatgatcagctacggcgggggctggcggctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccgcaagggcaaggtcatcgggctgtacggcaacggggtggtgaccaagtccggcgactacgtcagcgcgatcacccaggccgagcggatcggggagcccgactacgaggtggacgaggacatcttccgcaagaagcggctgaccatcatggacctccaccccggcgccggcaagacgaagcgcatcctgccgtccatcgtgcgggaggccctgaagcgccggctgcgcaccctcatcctggcgcccacccgggtcgtggccgccgagatggaggaggccctgcgcgggctccccatccggtaccagacccccgccgtgaagagcgagcacacgggccgcgagatcgtcgacctgatgtgccacgcgaccttcaccacccggctgctctccagcacgcgcgtgccgaactacaacctgatcgtgatggacgaggcccacttcaccgaccccagctccgtcgccgcccgggggtacatcagcacccgcgtggagatgggcgaggccgcggccatcttcatgaccgccacgccccccggggccaccgacccgttcccccagtccaacagccccatcgaggacatcgagcgggagatccccgagcgctcctggaacaccggcttcgactggatcaccgactaccagggcaagacggtctggttcgtgccgagcatcaaggccgggaacgacatcgcgaactgcctgcgcaagtccggcaagaaggtgatccagctcagccggaagaccttcgacaccgagtaccccaagaccaagctgacggactgggacttcgtcgtgaccaccgacatctccgagatgggggccaacttccgcgccggccgggtgatcgacccccgccggtgcctgaagcccgtcatcctcaccgacgggccggagcgcgtgatcctggccggccccatccccgtgacgcccgcgagcgccgcccagcggcgcggccggatcgggcgcaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgggagaagacgcaggccatcgacggcgagttccgcctccggggggagcagcgcaagaccttcgtggagctgatgcggcgcggcgacctgcccgtgtggctcagctacaaggtcgcctccgccgggatcagctacaaggaccgggagtggtgcttcaccggcgagcgcaacaaccagatcctggaggagaacatggaggtggagatctggacccgggagggggagaagaagaagctgcgccccaagtggctcgacgcccgggtgtacgcggaccccatggccctgaaggacttcaaggagttcgcctccggccgcaagagcatcaccctggacatcctcacggagatcgcctccctgccgacctacctgagctcccgcgccaagctcgcgctggacaacatcgtcatgctgcacaccaccgagcggggcgggcgcgcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcggaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcgccccgcctccgcgtggaccctgtacgccgtggccacgaccatcctcaccccgatgctgcggcacaccatcgagaacacgagcgccaacctgtccctcgccgcgatcgccaaccaggccgccatcctgatggggctgggcaagggctggcccctccaccgcatggacctgggggtccccctgctcgccatgggctgctacagccaggtgaaccccaccaccctgaccgcgtccctggtgatgctcctggtccactacgccatcatcgggccgggcctgcaggccaaggccacgcgggaggcgcagaagcgcaccgccgccggcatcatgaagaaccccaccgtggacgggatcaccgtgatcgacctcgagcccatcagctacgaccccaagttcgagaagcagctgggccaggtcatgctgctcgccctgtgcgccgggcagctgctcctgatgcggacgacctgggcgttctgcgaggtgctgaccctcgccaccggcccgatcctgacgctgtgggaggggaaccccggccgcttctggaacaccaccatcgccgtgtccaccgccaacatcttccggggcagctacctcgccggggcgggcctggccttctccctgatcaagaacgcccagacgccccgccgggggaccggcaccaccggggagaccctcggcgagaagtggaagcgccagctgaacagcctggaccggaaggagttcgaggagtacaagcgctccggcatcctcgaggtcgaccggacggaggccaagagcgccctgaaggacgggtccaagatcaagcacgcggtgagccgcggctccagcaagatccggtggatcgtggagcgcgggatggtcaagcccaagggcaaggtggtggacctggggtgcggccgcggcgggtggtcctactacatggccaccctcaagaacgtcaccgaggtgaagggctacaccaaggggggcccggggcacgaggagcccatccccatggccacgtacggctggaacctggtgaagctgcacagcggcgtcgacgtgttctacaagcccaccgagcaggtggacaccctcctgtgcgacatcggggagagctccagcaacccgaccatcgaggagggccggacgctgcgcgtcctcaagatggtggagccctggctgtccagcaagcccgagttctgcatcaaggtgctgaacccctacatgccgaccgtcatcgaggagctggagaagctccagcggaagcacgggggcaacctggtgcgctgccccctgtcccggaacagcacccacgagatgtactgggtgtccggcgccagcgggaacatcgtctccagcgtgaacaccacgtccaagatgctcctgaaccgcttcaccacccggcaccgcaagcccacctacgagaaggacgtcgacctgggcgcggggacgcggagcgtgtccaccgagaccgagaagcccgacatgaccatcatcggccgccggctccagcgcctgcaggaggagcacaaggagacgtggcactacgaccaggagaacccgtaccggacctgggcctaccacgggagctacgaggccccctccaccggcagcgcctccagcatggtgaacggcgtcgtgaagctgctcaccaagccctgggacgtgatcccgatggtcacgcagctggccatgaccgacaccacccccttcgggcagcagcgcgtgttcaaggagaaggtggacacgcggaccccccagcccaagccgggcacccgcatggtcatgaccacgaccgcgaactggctgtgggccctcctggggaagaagaagaacccccggctgtgcacccgcgaggagttcatctccaaggtgcggagcaacgccgccatcggcgccgtgttccaggaggagcaggggtggaccagcgcgtccgaggccgtcaacgacagccgcttctgggagctcgtggacaaggagcgggccctgcaccaggagggcaagtgcgagtcctgcgtgtacaacatgatgggcaagcgcgagaagaagctgggggagttcggccgcgccaaggggagccgggccatctggtacatgtggctcggcgcgcgcttcctggagttcgaggccctggggttcctcaacgaggaccactggttcggccgggagaactcctggagcggcgtcgagggggagggcctgcaccgcctggggtacatcctcgaggagatcgacaagaaggacggcgacctgatgtacgccgacgacacggccggctgggacacccggatcaccgaggacgacctgcagaacgaggagctcatcaccgagcagatggcgccccaccacaagatcctggccaaggccatcttcaagctgacctaccagaacaaggtggtgaaggtcctccgccccacgccgcggggggccgtgatggacatcatctcccgcaaggaccagcggggcagcgggcaggtgggcacctacgggctgaacaccttcaccaacatggaggtccagctgatccgccagatggaggccgagggcgtgatcacgcaggacgacatgcagaaccccaagggcctcaaggagcgggtggagaagtggctgcgcgagtgcggggtcgaccggctgaagcgcatggcgatctccggcgacgactgcgtggtgaagcccctcgacgagcggttcgggaccagcctgctgttcctcaacgacatgggcaaggtccgcaaggacatcccccagtgggagccgtccaaggggtggaagaactggcaggaggtgcccttctgcagccaccacttccacaagatcttcatgaaggacggccggtccctggtggtcccctgccgcaaccaggacgagctgatcggccgggcccgcatcagccagggggccggctggtccctccgcgagaccgcctgcctggggaaggcctacgcgcagatgtggagcctgatgtacttccaccggcgcgacctccggctggcctccatggccatctgcagcgccgtgcccaccgagtggttcccgacgagccgcaccacctggtccatccacgcccaccaccagtggatgaccacggaggacatgctgaaggtgtggaaccgggtctggatcgaggacaaccccaacatgatcgacaagacccccgtgcacagctgggaggacatcccctacctcggcaagcgcgaggacctgtggtgcgggtccctgatcggcctcagctcccgggcgacctgggccaagaacatccacaccgccatcacgcaggtgcgcaacctgatcggcaaggaggagtacgtcgactacatgccggtgatgaagcggtacagcgccccctccgagagcgagggggtgctgtga

SEQ ID NO: 10536 - RNA, 9867 nt, synthetic construct
  misc_feature 1..9867: note = derived and/or modified CDS sequence (opt1) from DENV-4__HQ332176__SS-prME
  source 1..9867: mol_type = other RNA
agcaccatcaccctgctctgcctgatccccacggtgatggccttccacctgtccacccgcgacggcgagccgctcatgatcgtcgcccggcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcgccggcgcgagaagcggagcgtggccctgacgccgcactccggcatgggcctcgagacccgcgccgagacctggatgagctccgagggggcctggaagcacgcccagcgggtggagagctggatcctgcgcaaccccggcttcgcgctgctcgccgggttcatggcctacatgatcggccagaccgggatccagcggacggtcttcttcgtgctgatgatgctggtggccccctcctacggcatgcgctgcgtcggcgtggggaaccgggacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcgcacctactgcatcgaggccctcatctccaacatcacgaccgcgacccggtgcccgacccagggggagccctacctgaaggaggagcaggaccagcagtacatctgccgccgggacgtggtcgaccgcggctgggggaacggctgcggcctgttcgggaagggcggggtggtgacgtgcgccaagttcagctgctccggcaagatcaccgggaacctcgtccagatcgagaacctggagtacaccgtggtggtcaccgtgcacaacggcgacacgcacgccgtcggcaacgacaccagcaaccacggggtgaccgccaccatcacgccccggtcccccagcgtggaggtcaagctgccggactacggcgagctcaccctggactgcgagccccgctccgggatcgacttcaacgagatgatcctgatgaagatgaagaagaagacctggctcgtgcacaagcagtggttcctggacctgcccctcccctggaccaccggcgccgacacgagcgaggtgcactggaactacaaggagcggatggtcaccttcaaggtgccgcacgcgaagcgccaggacgtgaccgtcctggggtcccaggagggcgccatgcacagcgccctggccggcgccaccgaggtggacagcggggacggcaaccacatgttcgcggggcacctcaagtgcaaggtgcgcatggagaagctgcggatcaagggcatgtcctacacgatgtgcagcggcaagttctccatcgacaaggagatggccgagacccagcacgggaccaccgtcgtgaaggtgaagtacgagggcgccggggccccctgcaaggtccccatcgagatccgcgacgtgaacaaggagaaggtggtcggccgggtgatcagcgccacgcccctggcggagaacaccaactccgtgaccaacatcgagctcgagccgcccttcggggacagctacatcgtcatcggcgtgggcaactccgccctgaccctgcactggttccgcaaggggagctccatcggcaagatgttcgagagcacgtaccggggggccaagcgcatggccatcctcggcgagaccgcgtgggacttcgggtccgtgggcggcctgttcaccagcctggggaaggccgtccaccaggtgttcggctccgtgtacaccacgatgttcgggggcgtcagctggatgatccggatcctcatcgggttcctggtgctgtggatcggcaccaactcccgcaacaccagcatggccatgacctgcatcgccgtgggcgggatcacgctgttcctcggcttcaccgtccaggccgacatggggtgcgtggtgtcctggagcggccgggagctgaagtgcgggtccggcatcttcgtcgtggacaacgtgcacacctggaccgagcagtacaagttccagcccgagagccccgcgcgcctggccagcgccatcctcaacgcccacaaggacggcgtctgcgggatccggtccacgacccgcctggagaacgtgatgtggaagcagatcaccaacgagctgaactacgtgctctgggagggcgggcacgacctgaccgtcgtggccggcgacgtgaagggcgtcctgacgaaggggaagcgggcgctcaccccgcccgccagcgacctgaagtactcctggaagacctggggcaaggccaagatcttcacccccgaggcccgcaacagcacgttcctgatcgacgggcccgacacctccgagtgcccgaacgagcggcgcgcctggaacagcttcgaggtggaggactacggcttcgggatgttcaccaccaacatctggatgaagttccgggagggctccagcgaggtgtgcgaccaccgcctcatgtccgcggccatcaaggaccagaaggccgtccacgccgacatgggctactggatcgagagctccaagaaccagacgtggcagatcgagcgggcgagcctgatcgaggtgaagacctgcctgtggcccaagacccacaccctctggtccaacggggtgctggagagccagatgctgatccccaagtcctacgccggcccgttcagccagcacaactaccgccaggggtacgccacccagacggtcggcccctggcacctcgggaagctggagatcgacttcggcgagtgccccggcaccaccgtgaccatccaggagaactgcgaccaccgcgggccctccctgcggacgaccaccgccagcggcaagctcgtgacccagtggtgctgccgcagctgcacgatgccgcccctgcggttcctgggggaggacggctgctggtacgggatggagatccgccccctctccgagaaggaggagaacatggtcaagagccaggtgaccgccggccagggcacctccgagaccttcagcatggggctgctgtgcctcacgctgttcgtcgaggagtgcctgcggcgccgggtgacccgcaagcacatgatcctcgcggtggtcatcaccctgtgcgccatcatcctgggcgggctcacctggatggacctgctgcgggccctcatcatgctgggcgacacgatgtccggccgcatcgggggccagacccacctggccatcatggccgtgttcaagatgagccccgggtacgtgctcggcgtcttcctgcggaagctgacctcccgcgagaccgcgctcatggtgatcgggatggccatgacgaccaccctgagcatcccgcacgacctgatggagctcatcgacggcatctccctgggcctgatcctcctgaagatcgtgacccagttcgacaacacgcaggtcgggaccctggccctcagcctgaccttcatccggtccaccatgagcctggtgatggcctggcgcacgatcatggccgtgctcttcgtcgtgaccctgatccccctgtgccggacctcctgcctccagaagcagagccactgggtggagatcaccgcgctgatcctgggcgcccaggccctccccgtctacctgatgacgctgatgaagggggcctcccgccggagctggcccctcaacgagggcatcatggcggtggggctggtgtccctgctcggcagcgccctgctgaagaacgacgtcccgctcgccggccccatggtggccgggggcctgctgctcgccgcgtacgtgatgtccgggagcagcgccgacctgtccctggagaaggccgccaacgtccagtgggacgagatggccgacatcaccggcagctcccccatcatcgaggtgaagcaggacgaggacgggagcttctccatccgcgacgtggaggagaccaacatgatcaccctcctggtcaagctggcgctcatcacggtgagcggcctgtaccccctggccatcccgatcaccatgaccctctggtacatgtggcaggtgaagacccagcggtccggcgccctgtgggacgtccccagccccgccgccacccagaaggcggccctgtccgagggggtgtaccgcatcatgcagcggggcctcttcgggaagacgcaggtgggcgtcgggatccacatggagggcgtgttccacaccatgtggcacgtgacccgcggcagcgtcatctgccacgagaccgggcgcctggagccctcctgggccgacgtgcggaacgacatgatcagctacggcgggggctggcgcctgggcgacaagtgggacaaggaggaggacgtgcaggtcctcgccatcgagccggggaagaaccccaagcacgtgcagacgaagcccggcctgttcaagaccctgaccggggagatcggcgccgtgaccctcgacttcaagcccgggacgtccggcagcccgatcatcaaccggaagggcaaggtcatcgggctgtacggcaacggggtggtgaccaagtccggcgactacgtcagcgcgatcacccaggccgagcgcatcggggagcccgactacgaggtggacgaggacatcttccggaagaagcgcctgaccatcatggacctccaccccggcgccggcaagacgaagcggatcctgccgtccatcgtgcgcgaggccctgaagcggcgcctgcggaccctcatcctggcgcccacccgcgtcgtggccgccgagatggaggaggccctgcgggggctccccatccgctaccagacccccgccgtgaagagcgagcacacgggccgggagatcgtcgacctgatgtgccacgcgaccttcaccacccgcctgctctccagcacgcgggtgccgaactacaacctgatcgtgatggacgaggcccacttcaccgaccccagctccgtcgccgcccgcgggtacatcagcacccgggtggagatgggcgaggccgcggccatcttcatgaccgccacgccccccggggccaccgacccgttcccccagtccaacagccccatcgaggacatcgagcgcgagatccccgagcgctcctggaacaccggcttcgactggatcaccgactaccagggcaagacggtctggttcgtgccgagcatcaaggccgggaacgacatcgcgaactgcctgcggaagtccggcaagaaggtgatccagctcagccgcaagaccttcgacaccgagtaccccaagaccaagctgacggactgggacttcgtcgtgaccaccgacatctccgagatgggggccaacttccgggccggccgcgtgatcgacccccggcgctgcctgaagcccgtcatcctcaccgacgggccggagcgggtgatcctggccggccccatccccgtgacgcccgcgagcgccgcccagcgccggggccgcatcgggcggaacccggcccaggaggacgaccagtacgtcttctccggcgaccccctgaagaacgacgaggaccacgcccactggaccgaggcgaagatgctcctggacaacatctacacccccgaggggatcatccccaccctgttcggcccggagcgcgagaagacgcaggccatcgacggcgagttccggctccgcggggagcagcggaagaccttcgtggagctgatgcgccggggcgacctgcccgtgtggctcagctacaaggtcgcctccgccgggatcagctacaaggaccgcgagtggtgcttcaccggcgagcggaacaaccagatcctggaggagaacatggaggtggagatctggacccgcgagggggagaagaagaagctgcggcccaagtggctcgacgcccgcgtgtacgcggaccccatggccctgaaggacttcaaggagttcgcctccggccgcaagagcatcaccctggacatcctcacggagatcgcctccctgccgacctacctgagctcccgggccaagctcgcgctggacaacatcgtcatgctgcacaccaccgagcgcggcgggcgggcctaccagcacgccctcaacgagctgcccgagagcctggagacgctcatgctggtggccctgctcggcgcgatgaccgccgggatcttcctgttcttcatgcagggcaaggggatcggcaagctgagcatgggcctcatcaccatcgccgtggcctccgggctgctgtgggtcgccgagatccagccccagtggatcgcggccagcatcatcctcgagttcttcctgatggtgctgctcatcccggagcccgagaagcagcgcaccccccaggacaaccagctgatctacgtgatcctgacgatcctcaccatcatcggcctgatcgccgccaacgagatggggctgatcgagaagaccaagaccgacttcggcttctaccaggtcaagacggagaccaccatcctcgacgtggacctgcggcccgcctccgcgtggaccctgtacgccgtggccacgaccatcctcaccccgatgctgcgccacaccatcgagaacacgagcgccaacctgtccctcgccgcgatcgccaaccaggccgccgtcctgatggggctgggcaagggctggcccctccaccggatggacctgggggtgcccctgctcgccatgggctgctacagccaggtgaaccccaccaccctgaccgcgtccctggtcatgctcctggtgcactacgccatcatcgggccgggcctgcaggccaaggccacgcgcgaggcgcagaagcggaccgccgccggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcgcacgacctgggccttctgcgaggtcctgaccctcgcgaccggcccgatcctgacgctgtgggaggggaaccccggccggttctggaacaccaccatcgccgtgtccaccgccaacatcttccgcggcagctacctcgccggggccggcctggcgttctccctgatcaagaacgcccagacgccccggcgcgggaccggcaccaccggggagaccctcggcgagaagtggaagcggcagctgaacagcctggaccgcaaggagttcgaggagtacaagcggtccggcatcctcgaggtggaccgcacggaggccaagagcgccctgaaggacgggtccaagatcaagcacgccgtcagccggggctccagcaagatccgctggatcgtggagcgcgggatggtgaagcccaagggcaaggtcgtggacctggggtgcggccggggcgggtggtcctactacatggcgaccctcaagaacgtgaccgaggtcaagggctacaccaaggggggcccggggcacgaggagcccatccccatggccacgtacggctggaacctggtgaagctgcacagcggcgtggacgtcttctacaagcccaccgagcaggtggacaccctcctgtgcgacatcggggagagctccagcaacccgaccatcgaggagggccgcacgctgcgggtgctcaagatggtcgagccctggctgtccagcaagcccgagttctgcatcaaggtgctgaacccctacatgccgaccgtgatcgaggagctggagaagctccagcgcaagcacgggggcaacctggtccggtgccccctgtcccgcaacagcacccacgagatgtactgggtgtccggcgccagcgggaacatcgtctccagcgtgaacaccacgtccaagatgctcctgaaccggttcaccacccgccaccggaagcccagctacgagaaggacgtggacctgggcgccgggacccgctccgtcagcacggagaccgagaagcccgacatgaccatcatcggccggcgcctccagcggctgcaggaggagcacaaggagacctggcactacgaccaggagaacccgtaccgcacgtgggcgtaccacgggtcctacgaggcccccagcaccggctccgccagctccatggtgaacggcgtggtcaagctgctcaccaagccctgggacgtgatcccgatggtgacccagctggccatgacggacaccacccccttcgggcagcagcgggtcttcaaggagaaggtggacacccgcacgccccagcccaagccgggcacccggatggtgatgaccaccacggccaactggctgtgggcgctcctggggaagaagaagaacccccgcctgtgcacccgggaggagttcatcagcaaggtccgcagcaacgccgccatcggcgccgtgttccaggaggagcaggggtggacctccgccagcgaggcggtgaacgactcccggttctgggagctcgtcgacaaggagcgcgccctgcaccaggagggcaagtgcgagagctgcgtgtacaacatgatgggcaagcgcgagaagaagctgggggagttcggccgggccaaggggtcccgcgccatctggtacatgtggctcggcgcccggttcctggagttcgaggcgctggggttcctcaacgaggaccactggttcggccgcgagaacagctggtccggcgtggagggggagggcctgcaccggctggggtacatcctcgaggagatcgacaagaaggacggcgacctgatgtacgccgacgacaccgccggctgggacacgcgcatcaccgaggacgacctgcagaacgaggagctcatcaccgagcagatggccccccaccacaagatcctggcgaaggccatcttcaagctgacctaccagaacaaggtcgtgaaggtgctccggcccaccccgcgcggggccgtcatggacatcatcagccggaaggaccagcgcggctccgggcaggtgggcacgtacgggctgaacaccttcaccaacatggaggtgcagctgatccggcagatggaggccgagggcgtcatcacccaggacgacatgcagaaccccaagggcctcaaggagcgcgtggagaagtggctgcgggagtgcggggtggaccgcctgaagcggatggccatcagcggcgacgactgcgtcgtgaagcccctcgacgagcgcttcgggacgtccctgctgttcctcaacgacatgggcaaggtgcggaaggacatcccccagtgggagccgagcaaggggtggaagaactggcaggaggtccccttctgctcccaccacttccacaagatcttcatgaaggacggccgcagcctggtggtgccctgccggaaccaggacgagctgatcggccgcgcgcgcatctcccagggggccggctggagcctccgggagaccgcctgcctggggaaggcctacgcccagatgtggtccctgatgtacttccaccgccgggacctccgcctggcgagcatggccatctgcagcgccgtccccaccgagtggttcccgacctcccggacgacctggagcatccacgcccaccaccagtggatgaccaccgaggacatgctgaaggtgtggaaccgcgtgtggatcgaggacaaccccaacatgatcgacaagacgcccgtccactcctgggaggacatcccctacctcggcaagcgggaggacctgtggtgcgggagcctgatcggcctctccagccgcgccacctgggcgaagaacatccacaccgccatcacccaggtgcggaacctgatcggcaaggaggagtacgtggactacatgccggtcatgaagcgctactccgcccccagcgagtccgagggggtgctgtga

SEQ ID NO: 10537 - RNA, 9867 nt, synthetic construct
  misc_feature 1..9867: note = derived and/or modified CDS sequence (opt1) from DENV-4__HQ332174__SS-prME
  source 1..9867: mol_type = other RNA
agcaccatcaccctgctctgcctgatccccaccgcgatggccttccacctgtccacccgggacggcgagcccctcatgatcgtggcgaagcacgagcgggggcgccccctgctgttcaagaccaccgagggcatcaacaagtgcaccctcatcgccatggacctgggggagatgtgcgaggacaccgtgacctacaagtgccccctgctcgtgaacaccgagcccgaggacatcgactgctggtgcaacctgacgagcacctgggtgatgtacgggacctgcacccagtccggggagcggcgccgggagaagcgcagcgtggccctgacgccgcactccggcatgggcctcgagacccgggccgagacctggatgagctccgagggggcctggaagcacgcgcagcgcgtggagagctggatcctgcggaaccccggcttcgccctgctcgccgggttcatggcctacatgatcggccagaccgggatccagcgcacggtgttcttcgtcctgatgatgctggtggcgccctcctacggcatgcggtgcgtgggcgtcgggaaccgcgacttcgtggagggcgtgagcgggggcgcctgggtcgacctcgtgctggagcacggcgggtgcgtgaccaccatggcccagggcaagcccaccctggacttcgagctcacgaagaccaccgccaaggaggtcgccctgctgcggacctactgcatcgaggcgctcatctccaacatcacgaccgccacccgctgcccgacccagggggagccctacctgaaggaggagcaggaccagcagtacatctgccggcgcgacgtggtggaccggggctgggggaacggctgcggcctgttcgggaagggcggggtcgtgacgtgcgccaagttcagctgctccggcaagatcaccgggaacctcgtgcagatcgagaacctggagtacaccgtcgtggtgaccgtccacaacggcgacacgcacgccgtgggcaacgacaccagcaaccacggggtcaccgccaccatcacgccccgctcccccagcgtggaggtgaagctgccggactacggcgagctcaccctggactgcgagccccggtccgggatcgacttcaacgagatgatcctgatgaagatgaagaagaagacctggctcgtccacaagcagtggttcctggacctgcccctcccctggaccaccggcgcggacacgagcgaggtgcactggaactacaaggagcgcatggtgaccttcaaggtcccgcacgccaagcggcaggacgtgaccgtgctggggtcccaggagggcgccatgcacagcgccctggccggcgcgaccgaggtcgacagcggggacggcaaccacatgttcgccgggcacctcaagtgcaaggtgcgcatggagaagctgcgcatcaagggcatgtcctacacgatgtgcagcggcaagttctccatcgacaaggagatggccgagacccagcacgggaccaccgtggtcaaggtgaagtacgagggcgccggggccccctgcaaggtgcccatcgagatccgggacgtcaacaaggagaaggtggtgggccgcgtcatcagcgcgacgcccctggccgagaacaccaactccgtgaccaacatcgagctcgagccgcccttcggggacagctacatcgtgatcggcgtcggcaactccgccctgaccctgcactggttccggaaggggagctccatcggcaagatgttcgagagcacgtaccgcggggccaagcggatggcgatcctcggcgagaccgcctgggacttcgggtccgtgggcggcctgttcaccagcctggggaaggccgtgcaccaggtcttcggctccgtgtacaccacgatgttcgggggcgtgagctggatgatccgcatcctcatcgggttcctggtcctgtggatcggcaccaactcccggaacaccagcatggccatgacctgcatcgccgtgggcgggatcacgctgttcctcggcttcaccgtgcaggcggacatggggtgcgtcgtgtcctggagcggccgcgagctgaagtgcgggtccggcatcttcgtggtcgacaacgtgcacacctggaccgagcagtacaagttccagcccgagagccccgcccggctggccagcgccatcctcaacgcccacaaggacggcgtgtgcgggatccgctccacgacccggctggagaacgtcatgtggaagcagatcaccaacgagctgaactacgtgctctgggagggcgggcacgacctgaccgtggtcgcgggcgacgtgaagggcgtgctgacgaaggggaagcgcgccctcaccccgcccgccagcgacctgaagtactcctggaagacctggggcaaggccaagatcttcacccccgaggcccggaacagcacgttcctgatcgacgggcccgacacctccgagtgcccgaacgagcgccgggcgtggaacagcttcgaggtcgaggactacggcttcgggatgttcaccaccaacatctggatgaagttccgcgagggctccagcgaggtgtgcgaccaccggctcatgtccgccgccatcaaggaccagaaggccgtgcacgcggacatgggctactggatcgagagctccaagaaccagacgtggcagatcgagcgcgccagcctgatcgaggtcaagacctgcctgtggcccaagacccacaccctctggtccaacggggtgctggagagccagatgctgatccccaagtcctacgccggcccgttcagccagcacaactaccggcaggggtacgccacccagacgatgggcccctggcacctcgggaagctggagatcgacttcggcgagtgccccggcaccaccgtgaccatccaggagaactgcgaccaccgcgggccctccctgcgcacgaccaccgccagcggcaagctcgtcacccagtggtgctgccggagctgcacgatgccgcccctgcgcttcctgggggaggacggctgctggtacgggatggagatccggcccctctccgagaaggaggagaacatggtcaagagccaggtgaccgcgggccagggcgcctccgagaccttcagcatggggctgctgtgcctcaccctgttcgtcgaggagtgcctgcgccggcgcgtgacgcggaagcacatgatcctcgccgtcgtgatcaccctgtgcgccatcatcctgggcgggctcacctggatggacctgctgcgcgccctcatcatgctgggcgacaccatgtccggccggatcgggggccagacgcacctggcgatcatggccgtgttcaagatgagccccgggtacgtcctcggcgtgttcctgcgcaagctgacctcccgggagaccgccctcatggtgatcgggatggccatgaccacgaccctgagcatcccgcacgacctgatggagctcatcgacggcatctccctgggcctgatcctcctgaagatcgtcacccagttcgacaacacccaggtggggacgctggccctcagcctgaccttcatccgctccaccatgagcctggtgatggcgtggcggaccatcatggccgtcctcttcgtggtgacgctgatccccctgtgccgcacctcctgcctccagaagcagagccactgggtcgagatcaccgccctgatcctgggcgcccaggcgctccccgtgtacctgatgaccctgatgaagggggcctcccggcgcagctggcccctcaacgagggcatcatggccgtggggctggtctccctgctcggcagcgccctgctgaagaacgacgtgccgctcgccggccccatggtggccggcgggctgctgctcgccgcctacgtcatgtccgggagcagcgccgacctgtccctggagaaggccgcgaacgtgcagtgggacgagatggccgacatcacggggagctcccccatcatcgaggtgaagcaggacgaggacgggagcttctccatccgggacgtcgaggagaccaacatgatcaccctcctggtgaagctggccctcatcaccgtgagcggcctgtaccccctggccatcccgatcacgatgaccctctggtacatgtggcaggtcaagacccagcgctccggcgccctgtgggacgtgcccagccccgcggccacccagaaggccgccctgtccgagggggtgtaccggatcatgcagcgcggcctcttcgggaagacccaggtcggcgtggggatccacatggagggcgtgttccacacgatgtggcacgtcacccggggcagcgtgatctgccacgagaccgggcgcctggagccctcctgggccgacgtgcgcaacgacatgatcagctacggcgggggctggcggctgggcgacaagtgggacaaggaggaggacgtccaggtgctcgcgatcgagccggggaagaaccccaagcacgtgcagaccaagcccggcctgttcaagacgctgaccggggagatcggcgccgtcaccctcgacttcaagcccgggacctccggcagcccgatcatcaaccgcaagggcaaggtgatcgggctgtacggcaacggggtggtcacgaagtccggcgactacgtgagcgccatcacccaggccgagcggatcggggagcccgactacgaggtggacgaggacatcttccgcaagaagcggctgaccatcatggacctccaccccggcgcgggcaagaccaagcgcatcctgccgtccatcgtccgggaggccctgaagcgccggctgcgcacgctcatcctggcccccacccgggtggtggccgccgagatggaggaggcgctgcgcgggctccccatccggtaccagacccccgccgtcaagagcgagcacaccggccgcgagatcgtggacctgatgtgccacgccacgttcaccacccggctgctctccagcacccgcgtgccgaactacaacctgatcgtcatggacgaggcccacttcacggaccccagctccgtggccgcgcgggggtacatcagcacccgcgtggagatgggcgaggccgccgccatcttcatgaccgccacgccgcccggggcgacggacccgttcccccagtccaacagccccatcgaggacatcgagcgggagatccccgagcgctcctggaacaccggcttcgactggatcaccgactaccagggcaagaccgtctggttcgtgccgagcatcaaggccgggaacgacatcgccaactgcctgcgcaagtccggcaagaaggtcatccagctcagccggaagacgttcgacaccgagtaccccaagaccaagctgaccgactgggacttcgtggtgacgaccgacatctccgagatgggggccaacttccgcgcgggccgggtcatcgacccccgccggtgcctgaagcccgtgatcctcaccgacgggccggagcgcgtgatcctggccggccccatccccgtcacccccgccagcgccgcccagcggcgcggccggatcgggcgcaacccggcgcaggaggacgaccagtacgtgttctccggcgaccccctgaagaacgacgaggaccacgcccactggacggaggccaagatgctcctggacaacatctacacccccgaggggatcatccccaccctgttcggcccggagcgggagaagacccaggccatcgacggcgagttccgcctccgcggggagcagcgcaagacgttcgtggagctgatgcggcgcggcgacctgcccgtctggctcagctacaaggtggcctccgcggggatcagctacaaggaccgggagtggtgcttcaccggcgagcgcaacaaccagatcctggaggagaacatggaggtggagatctggacccgggagggggagaagaagaagctgcgccccaagtggctcgacgcccgggtctacgccgaccccatggccctgaaggacttcaaggagttcgcctccggccgcaagagcatcaccctggacatcctcaccgagatcgcgtccctgccgacgtacctgagctcccgcgccaagctcgccctggacaacatcgtgatgctgcacaccaccgagcggggcgggcgcgcctaccagcacgcgctcaacgagctgcccgagagcctggagaccctcatgctggtggccctgctcggcgccatgacggccgggatcttcctgttcttcatgcagggcaaggggatcggcaagctgagcatgggcctcatcaccatcgccgtcgcgtccgggctgctgtgggtggccgagatccagccccagtggatcgccgccagcatcatcctcgagttcttcctgatggtgctgctcatcccggagcccgagaagcagcggacgccccaggacaaccagctgatctacgtcatcctgaccatcctcacgatcatcggcctgatcgccgcgaacgagatggggctgatcgagaagaccaagaccgacttcggcttctaccaggccaagaccgagacgaccatcctcgacgtggacctgcgccccgcctccgcctggaccctgtacgccgtggcgaccacgatcctcaccccgatgctgcggcacaccatcgagaacaccagcgccaacctgtccctcgccgccatcgccaaccaggcggccgtcctgatggggctgggcaagggctggcccctccaccgcatggacctgggggtgcccctgctcgccatgggctgctacagccaggtgaaccccacgaccctgaccgcctccctggtcatgctcctggtgcactacgcgatcatcgggccgggcctgcaggccaaggccacccgggaggcccagaagcgcacggccgcgggcatcatgaagaaccccaccgtggacgggatcaccgtcatcgacctcgagcccatcagctacgaccccaagttcgagaagcagctgggccaggtgatgctgctcgtgctgtgcgccgggcagctgctcctgatgcggaccacgtgggccttctgcgaggtcctgaccctcgccaccggcccgatcctgaccctgtgggaggggaaccccggccgcttctggaacacgaccatcgccgtgtccaccgcgaacatcttccggggcagctacctcgccggggccggcctggccttctccctgatcaagaacgcccagacgccccggcgggggacgggcaccaccggggagaccctcggcgagaagtggaagcgccagctgaacagcctggaccggaaggagttcgaggagtacaagcgctccggcatcctcgaggtggaccggaccgaggccaagagcgccctgaaggacgggtccaagatcaagcacgccgtcagccgcggctccagcaagatccggtggatcgtggagcgcgggatggtgaagcccaagggcaaggtcgtggacctggggtgcggccgcggcgggtggtcctactacatggccacgctcaagaacgtgaccgaggtcaagggctacaccaagggcggcccggggcacgaggagcccatccccatggcgacctacggctggaacctggtgaagctgcacagcggcgtggacgtcttctacaagcccacggagcaggtcgacaccctcctgtgcgacatcggggagagctccagcaacccgaccatcgaggagggccggaccctgcgcgtgctcaagatggtcgagccctggctgtccagcaagcccgagttctgcatcaaggtgctgaacccctacatgccgacggtgatcgaggagctggagaagctccagcggaagcacgggggcaacctggtccgctgccccctgtcccggaacagcacccacgagatgtactgggtgtccggcgccagcgggaacatcgtgtccagcgtcaacaccacctccaagatgctcctgaaccgcttcacgacccggcaccgcaagcccacctacgagaaggacgtggacctgggcgccgggacccggagcgtctccacggagaccgagaagcccgacatgaccatcatcggccgccggctccagcgcctgcaggaggagcacaaggagacctggcactacgaccaggagaacccgtaccggacgtgggcctaccacgggagctacgaggccccctccaccggcagcgcgtccagcatggtgaacggcgtggtcaagctgctcaccaagccctgggacgtgatcccgatggtgacccagctggccatgacggacaccacccccttcgggcagcagcgcgtcttcaaggagaaggtggacacccggacgccccagcccaagccgggcacccgcaccgtgatgaccacgaccgccaactggctgtgggccctcctggggaagaagaagaacccccggctgtgcacccgcgaggagttcatctccaaggtccggagcaacgccgcgatcggcgccgtgttccaggaggagcaggggtggaccagcgcctccgaggccgtgaacgacagccgcttctgggagctcgtcgacaaggagcgggccctgcaccaggagggcaagtgcgagtcctgcgtgtacaacatgatgggcaagcgcgagaagaagctgggggagttcggccgcgcgaaggggagccgggccatctggtacatgtggctcggcgcccgcttcctggagttcgaggccctggggttcctcaacgaggaccactggttcggccgggagaactcctggagcggcgtggagggggagggcctgcaccgcctggggtacatcctcgaggagatcgacaagaaggacggcgacctgatgtacgcggacgacacggccggctgggacacccggatcaccgaggacgacctgcagaacgaggagctcatcaccgagcagatggcgccccaccacaagatcctggccaaggccatcttcaagctgacctaccagaacaaggtcgtgaaggtgctccgccccacgccgcgcggggcggtcatggacatcatctcccgcaaggaccagcggggcagcggccaggtgggcacctacgggctgaacaccttcaccaacatggaggtgcagctgatccgccagatggaggccgagggcgtcatcacgcaggacgacatgcagaaccccaagggcctcaaggagcgggtggagaagtggctgcgcgagtgcggggtggaccggctgaagcgcatggccatctccggcgacgactgcgtcgtgaagcccctcgacgagcggttcgggaccagcctgctgttcctcaacgacatgggcaaggtgcgcaaggacatcccccagtgggagccgtccaaggggtggaagaactggcaggaggtccccttctgcagccaccacttccacaagatcttcatgaaggacggccggtccctggtggtgccctgccgcaaccaggacgagctgatcggccgggcccgcatcagccagggggccggctggtccctccgcgagaccgcgtgcctggggaaggcctacgcccagatgtggagcctgatgtacttccaccggcgcgacctccggctggcctccatggccatctgcagcgcggtccccaccgagtggttcccgacgagccgcaccacctggtccatccacgcccaccaccagtggatgaccacggaggacatgctgaaggtgtggaaccgggtgtggatcgaggacaaccccaacatgatcgacaagacccccgtccacagctgggaggacatcccctacctcggcaagcgcgaggacctgtggtgcgggtccctgatcggcctcagctcccgggccacctgggccaagaacatccacaccgccatcacccaggtgcgcaacctgatcggcaaggaggagtacgtggactacatgccggtcatgaagcggtacagcgcgccctccgagagcgagggggtgctgtga

SEQ ID NO: 10538 - RNA, 9867 nt, synthetic construct
  misc_feature 1..9867: note = derived and/or modified CDS sequence (opt1) from DENV-4__KT026308__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcatcctgatgatgctggtggccccctcctacggcatgcggtgcgtgggcgtcgggaaccgcgacttcgtggagggcgtgagcgggggcgcgtgggtcgacctcgtgctggagcacggcgggtgcgtgaccaccatggcccagggcaagcccaccctggacttcgagctcatcaagacgaccgccaaggaggtcgccctgctgcggacctactgcatcgaggcctccatcagcaacatcaccacggcgacccgctgcccgacccagggggagccctacctcaaggaggagcaggaccagcagtacatctgccggcgcgacatggtggaccggggctgggggaacggctgcggcctgttcgggaagggcggggtggtcacctgcgccaagttctcctgcctgggcaagatcacggggaacctcgtgcagatcgagaacctggagtacaccgtggtcgtgaccgtgcacaacggcgacacccacgccgtcggcaacgacacgagcaaccacggggtgaccgccaccatcaccccccgctcccccagcgtcgaggtgcagctgccggactacggcgagctcacgctggactgcgagccccggtccgggatcgacttcaacgagatgatcctgatgaagatgaagaccaagacctggctcgtgcacaagcagtggttcctggacctgcccctcccctggaccaccggcgccgacacgctggaggtccactggaaccacaaggagcgcatggtgaccttcaaggtgccgcacgcgaagcggcaggacgtcaccgtgctggggagccaggagggcgccatgcactccgccctcgccggcgccaccgaggtggacagcggggacggcaaccacatgttcgcggggcacctgaagtgcaaggtccgcatggagaagctgcgcatcaagggcatgagctacacgatgtgctccggcaagttcagcatcgacaaggagatggccgagacccagcacgggaccaccgtggtgaaggtcaagtacgagggcacgggggccccctgcaaggtgcccatcgagatccgggacgtgaacaaggagaaggtcgtgggccgcatcatctccagcacccccttcgccgagaacaccaactccgtgaccaacatcgagctcgagccgcccttcggggacagctacatcgtcatcggcgtgggcgactccgccctgacgctgcactggttccggaaggggagctccatcggcaagatgttcgagagcacctaccgcggggcgaagcggatggccatcctcggcgagaccgcctgggacttcgggtccgtgggcggcctgctgaccagcctcgggaaggccgtccaccaggtgttcggctccgtgtacacgaccatgttcgggggcgtcagctggatggtgcgcatcctgatcgggctgctggtgctctggatcggcaccaactcccggaacaccagcatggcgatgtcctgcatcgccgtcggcgggatcacgctgttcctgggcttcaccgtgcacgccgacatggggtgcgtggtcagctggtccggcaaggagctcaagtgcgggagcggcatcttcgtgatcgacaacgtgcacacctggaccgagcagtacaagttccagcccgagagccccgcccgcctggcctccgcgatcctgaacgcccacaaggagggcgtctgcgggatccggagcacgacccgcctcgagaacgtgatgtggaagcagatcaccaacgagctgaactacgtgctgtgggagggcgggcacgacctcaccgtcgtggccggcgacgtgaagggcgtcctgtccaaggggaagcgggccctggccccgcccgtgaacgacctcaagtacagctggaagacgtggggcaaggcgaagatcttcacccccgagacccgcaactccaccttcctggtggacgggcccgacacgagcgagtgcccgaacgagcggcgcgcctggaacttcctggaggtcgaggactacggcttcgggatgttcaccaccaacatctggatgaagttccgggagggctccagcgaggtgtgcgaccaccgcctcatgtccgccgccatcaaggaccagaaggccgtgcacgcggacatgggctactggatcgagagctccaagaaccagacctggcagatcgagaaggccagcctgatcgaggtcaagacgtgcctgtggcccaagacccacaccctctggtccaacggggtgctggagagccagatgctgatccccaaggcctacgccggcccgatctcccagcacaactaccggcaggggtacgcgacccagaccgccggcccctggcacctcgggaagctggagatcgacttcggcgagtgccccggcacgaccgtgaccgtccaggaggactgcgaccaccgcgggcccagcctgcggaccacgaccgcctccggcaagctcgtgacccagtggtgctgccgcagctgcaccatgccgcccctgcgcttcctgggggaggacggctgctggtacgggatggagatccggcccctcaacgagaaggaggagaacatggtgaagagccaggtctccgccggccacggcacgagcgagaccttctccatggggctgctgtgcctcaccctgttcgtggaggagtgcctgcgccggcgcgtcacccggaagcacatgatcctcgtggtggtcacgaccctgtgcgccatcatcctgggcgggctcacctggatggacctgctgcgcgcgctcatcatgctgggcgacaccatgagcggccggatggggggccagatccacctggccatcatggccgtgttcaagatgtcccccgggtacgtgctcggcatcttcctgcgcaagctgacgagccgggagaccgccctcatggtcatcgggatggccatgaccaccgtgctgtccatcccgcacgacctgatggagttcatcgacggcatcagcctcggcctgatcctgctcaagatggtgacgcacttcgacaacacccaggtcgggaccctggcgctggccctcaccttcatcaagtccacgatgcccctggtgatggcctggcgcaccatcatggccgtgctgttcgtcgtgaccctcatccccctgtgccggaccagctgcctgcagaagcagtcccactgggtggagatcacggccctcatcctgggcgcgcaggccctgcccgtctacctcatgaccctgatgaagggggccagcaagcgctcctggccgctgaacgagggcatcatggccgtggggctcgtgagcctgctgggctccgcgctcctgaagaacgacgtccccctggccggccccatggtggccgggggcctcctgctggccgcctacgtgatgagcgggtccagcgcggacctctccctggagaaggccgccaacgtccagtgggacgagatggccgacatcaccggcagcagccccatcatcgaggtgaagcaggacgaggacgggtccttcagcatccgggacgtggaggagaccaacatgatcacgctgctcgtcaagctggccctgatcaccgtgtccggcctctacccgctggcgatccccgtgaccatgaccctgtggtacatgtggcaggtcaagacgcagcgcagcggcgccctctgggacgtgccctcccccgccgccgcccagaaggcgaccctgaccgagggggtgtaccggatcatgcagcgcggcctgttcgggaagacccaggtcggcgtggggatccacaccgagggcgtgttccacacgatgtggcacgtcacccggggcagcgtgatctgccacgagtccgggcgcctcgagccgagctgggccgacgtgcggaacgacatgatctcctacggcgggggctggcgcctgggcgacaagtgggacaaggaggaggacgtccaggtgctggccatcgagcccgggaagaaccccaagcacgtgcagaccaagcccggcctcttcaagaccctgacgggggagatcggcgccgtcaccctggacttcaagccggggaccagcggctcccccatcatcaaccggaagggcaaggtgatcgggctctacggcaacggggtggtcaccaagagcggcgactacgtgtccgccatcacgcaggcggagcgcatcggggagcccgactacgaggtggacgaggacatcttccgcaagaagcggctgaccatcatggacctgcacccgggcgccggcaagaccaagcgcatcctgcccagcatcgtccgggaggccctcaagcgccggctgcgcaccctgatcctcgcccccacgcgggtggtggcggccgagatggaggaggccctgcgcgggctgcccatccggtaccagaccccggccgtcaagtccgagcacaccggccgcgagatcgtggacctcatgtgccacgccaccttcacgacccggctgctgagctccacccgcgtgcccaactacaacctcatcgtcatggacgaggcgcacttcaccgaccccagctccgtggccgcccgggggtacatcagcacgcgcgtcgagatgggcgaggccgccgcggtgttcatgaccgccacccccccggggaccacggaccccttcccccagagcaactcccccatcgaggacatcgagcgggagatcccggagcgcagctggaacaccggcttcgactggatcaccgactaccagggcaagaccgtgtggttcgtcccctccatcaaggccgggaacgacatcgccaactgcctgcggaagagcggcaagaaggtgatccagctgtcccgcaagacgttcgacaccgagtaccccaagaccaagctcaccgactgggacttcgtgatcacgaccgacatcagcgagatgggggccaacttccgggcgggccgcgtcatcgacccccgccggtgcctgaagccggtgatcctgaccgacgggcccgagcgcgtgatcctcgccggccccatccccgtcaccccggcctccgccgcgcagcggcgcggccggatcgggcgcaaccccgcccaggaggacgaccagtacgtgttcagcggcgaccccctgcggaacgacgaggaccacgcccactggacggaggccaagatgctgctcgacaacatctacacccccgaggggatcatcccgaccctgttcggccccgagcgcgagaagacccaggccatcgacggcgagttccggctgcgcggggagcagcggaagacgttcgtggagctcatgcgccggggcgacctgcccgtctggctgtcccacaaggtggcgagcgccgggatctcctacaaggaccgcgagtggtgcttcaccggcgagcggaacaaccagatcctcgaggagaacatggaggtggagatctggacccgcgagggggagaagaagaagctgcggcccaagtggctggacgcccgcgtctacgccgacccgatggccctcaaggacttcaaggagttcgcgagcggccggaagtccatcaccctggacatcctgaccgagatcgccagcctccccacgtacctgtccagccgcgccaagctggccctcgacaacatcgtgatgctgcacaccaccgagcggggcgggaaggcctaccagcacgcgctgaacgagctccccgagtccctggagaccctgatgctcgtggccctgctgggcgccatgacggccgggatcttcctcttcttcatgcagggcaaggggatgggcaagctgagcatgggcctgatcgcgatcgccgtcgcctccgggctcctgtgggtggccgagatccagccgcagtggatcgccgcgagcatcatcctggagttcttcctcatggtgctgctggtccccgagcccgagaagcagcgcaccccccaggacaaccagctcatctacgtgatcctgaccatcctgaccatcatcgccctcgtggccgccaacgagatgggcctgatcgagaagacgaagaccgacttcgggttctaccaggtcaaggccgagaccaccatcctggacgtggacctccgcccggcgagcgcctggacgctgtacgccgtggccaccaccatcctgacccccatgctccggcacacgatcgagaacacctccgccaacctgagcctggcggccatcgccaaccaggccgccgtcctcatgggcctggggaagggctggcccctgcaccgcatggacctcggcgtgcccctgctggcgatggggtgctactcccaggtgaacccgaccaccctcacggccagcctggtcatgctgctcgtgcactacgccatcatcggccccgggctgcaggccaaggcgacccgggaggcccagaagcgcaccgccgccggcatcatgaagaaccccaccgtggacggcatcacggtcatcgacctggagcccatctcctacgacccgaagttcgagaagcagctcgggcaggtgatgctgctggtgctctgcgtcggccagctgctgctcatgcggaccacctgggccttctgcgaggtgctgaccctggcgacggggcccatcctcaccctgtgggagggcaaccccgggcgcttctggaacaccaccatcgccgtgagcacggccaacatcttccggggctcctacctggccggcgccgggctcgcgttcagcctgatcaagaacgcccagaccccccgccggggcaccgggaccatgggcgagacgctgggggagaagtggaagcgccagctcaactccctggaccggaaggagttcgaggagtacaagcgcagcggcatcctggaggtcgaccggaccgaggcccgctccgccctcaaggacggcagcaagatcaagtacgccgtgtcccgggggaccagcaagatccgctggatcgtggagcggggcatggtcaagccgaaggggaaggtggtggacctgggctgcgggcgcggcggctggtcctactacatggcgaccctgaagaacgtcaccgaggtgaaggggtacacgaagggcgggcccggccacgaggagcccatccccatggccacctacgggtggaacctcgtgaagctgcacagcggcgtcgacgtgttctacaagccgaccgagcaggtggacaccctgctctgcgacatcggcgagtccagctccaaccccacgatcgaggaggggcggaccctgcgcgtcctgaagatggtggagccctggctgagcagcaagcccgagttctgcatcaaggtcctcaacccgtacatgcccaccgtgatcgaggagctggagaagctgcagcgccggcacggcgggtccctcgtgcgctgccccctgagccggaactccacccacgagatgtactgggtcagcggcgtgtccggcaacatcgtgagctccgtcaacacgaccagcaagatgctgctcaaccgcttcaccacccggcaccgcaagcccacgtacgagaaggacgccgacctgggggccggcacccggtccgtgagcaccgagaccgagaagccggacatgacgatcatcgggcgccggctgcagcgcctccaggaggagcacaaggagacctggcactacgaccacgagaacccctaccggacctgggcgtaccacggctcctacgaggcccccagcaccgggtccgccagctccatggtgaacggcgtcgtgaagctgctgacgaagccgtgggacgtggtccccatggtgacccagctcgccatgaccgacaccacgcccttcggccagcagcgcgtgttcaaggagaaggtcgacacccggaccccccagccgaagcccgggacccaggtggtgatgacgaccaccgccaactggctgtggaccctgctcggccgcaagaagaacccccggctgtgcacgcgcgaggagttcatcagcaaggtccggtccaacgcggccatcggggccgtgttccaggaggagcagggctggaccagcgcctccgaggccgtgaacgacagccgcttctgggagctggtcgacaaggagcgggcgctccaccaggaggggaagtgcgagagctgcgtgtacaacatgatgggcaagcgcgagaagaagctgggcgagttcgggcgggccaagggctcccgcgccatctggtacatgtggctgggggcccgcttcctcgagttcgaggccctgggcttcctgaacgaggaccactggttcgggcgggagaacagctggtccggcgtggagggcgaggggctccaccgcctgggctacatcctggaggacatcgacaagaaggacggggacctcatctacgcggacgacaccgccggctgggacacccggatcacggaggacgacctgctgaacgaggagctcatcaccgagcagatgaccccccaccacaagatcctggccaaggccatcttcaagctgacctaccagaacaaggtcgtgaaggtgctccgcccgacccccaagggcgcggtcatggacatcatcagccggaaggaccagcgcgggtccggccaggtggggacgtacggcctgaacaccttcaccaacatggaggtgcagctgatccggcagatggaggccgagggggtcatcacccgcgacgacatgcacaaccccaagggcctcaaggagcgggtggagaagtggctgaaggagtgcggcgtggaccgcctgaagcggatggccatcagcggggacgactgcgtcgtgaagcccctcgacgagcgcttctccacgagcctgctgttcctcaacgacatgggcaaggtgcggaaggacatcccgcagtgggagccctccaaggggtggaagaactggcaggaggtccccttctgcagccaccacttccacaagatcttcatgaaggacggccgctccctggtggtgccctgccggaaccaggacgagctgatcgggcgcgcccggatcagccagggcgccggctggtccctccgcgagaccgcgtgcctggggaaggcctacgcccagatgtggagcctgatgtacttccaccggcgcgacctccgcctggcctccatggccatctgcagcgcggtcccgaccgagtggttccccacctcccggacgacctggagcatccacgcccaccaccagtggatgaccaccgaggacatgctgaaggtgtggaaccgcgtgtggatcgaggacaaccccaacatgatcgacaagacgcccgtccacagctgggaggacatcccgtacctcggcaagcgggaggacctgtggtgcgggtccctgatcggcctcagctcccgcgccacctgggccaagaacatccacaccgccatcacccaggtgcggaacctgatcgggaaggaggagtacgtggactacatgcccgcgatgcgccggtacagcgcccacttcgagtccgagggcgtcctgtga

SEQ ID NO: 10539 - RNA, 9867 nt, synthetic construct
  misc_feature 1..9867: note = derived and/or modified CDS sequence (opt1) from DENV-4__KT026309__SS-prME
  source 1..9867: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcatcctgatgatgctggtggccccctcctacggcatgcggtgcgtgggcgtcgggaaccgcgacttcgtggagggcgtgagcgggggcgcgtgggtcgacctcgtgctggagcacggcgggtgcgtgaccaccatggcccagggcaagcccaccctggacttcgagctcatcaagacgaccgccaaggaggtcgccctgctgcggacctactgcatcgaggcctccatcagcaacatcaccacggcgacccgctgcccgacccagggggagccctacctcaaggaggagcaggaccagcagtacatctgccggcgcgacatggtggaccggggctgggggaacggctgcggcctgttcgggaagggcggggtggtcacctgcgccaagttctcctgcctgggcaagatcacggggaacctcgtgcagatcgagaacctggagtacaccgtggtcgtgaccgtgcacaacggcgacacccacgccgtcggcaacgacacgagcaaccacggggtgaccgccaccatcaccccccgctcccccagcgtcgaggtgcagctgccggactacggcgagctcacgctggactgcgagccccggtccgggatcgacttcaacgagatgatcctgatgaagatgaagaccaagacctggctcgtgcacaagcagtggttcctggacctgcccctcccctggaccaccggcgccgacacgctggaggtccactggaaccacaaggagcgcatggtgaccttcaaggtgccgcacgcgaagcggcaggacgtcaccgtgctggggagccaggagggcgccatgcactccgccctcgccggcgccaccgaggtggacagcggggacggcaaccacatgttcgcggggcacctgaagtgcaaggtccgcatggagaagctgcgcatcaagggcatgagctacacgatgtgctccggcaagttcagcatcgacaaggagatggccgagacccagcacgggaccaccgtggtgaaggtcaagtacgagggcacgggggccccctgcaaggtgcccatcgagatccgggacgtgaacaaggagaaggtcgtgggccgcatcatctccagcacccccttcgccgagaacaccaactccgtgaccaacatcgagctcgagccgcccttcggggacagctacatcgtcatcggcgtgggcgactccgccctgacgctgcactggttccggaaggggagctccatcggcaagatgttcgagagcacctaccgcggggcgaagcggatggccatcctcggcgagaccgcctgggacttcgggtccgtgggcggcctgctgaccagcctcgggaaggccgtccaccaggtgttcggctccgtgtacacgaccatgttcgggggcgtcagctggatggtgcgcatcctgatcgggctgctggtgctctggatcggcaccaactcccggaacaccagcatggcgatgtcctgcatcgccgtcggcgggatcacgctgttcctgggcttcaccgtgcacgccgacatggggtgcgtggtcagctggtccggcaaggagctcaagtgcgggagcggcatcttcgtgatcgacaacgtgcacacctggaccgagcagtacaagttccagcccgagagccccgcccgcctggcctccgcgatcctgaacgcccacaaggagggcgtctgcgggatccggagcacgacccgcctcgagaacgtgatgtggaagcagatcaccaacgagctgaactacgtgctgtgggagggcgggcacgacctcaccgtcgtggccggcgacgtgaagggcgtcctgtccaaggggaagcgggccctggccccgcccgtgaacgacctcaagtacagctggaagacgtggggcaaggcgaagatcttcacccccgagacccgcaactccaccttcctggtggacgggcccgacacgagcgagtgcccgaacgagcggcgcgcctggaacttcctggaggtcgaggactacggcttcgggatgttcaccaccaacatctggatgaagttccgggagggctccagcgaggtgtgcgaccaccgcctcatgtccgccgccatcaaggaccagaaggccgtgcacgcggacatgggctactggatcgagagctccaagaaccagacctggcagatcgagaaggccagcctgatcgaggtcaagacgtgcctgtggcccaagacccacaccctctggtccaacggggtgctggagagccagatgctgatccccaaggcctacgccggcccgatctcccagcacaactaccggcaggggtacgcgacccagaccgccggcccctggcacctcgggaagctggagatcgacttcggcgagtgccccggcacgaccgtgaccgtccaggaggactgcgaccaccgcgggcccagcctgcggaccacgaccgcctccggcaagctcgtgacccagtggtgctgccgcagctgcaccatgccgcccctgcgcttcctgggggaggacggctgctggtacgggatggagatccggcccctcaacgagaaggaggagaacatggtgaagagccaggtctccgccggccacggcacgagcgagaccttctccatggggctgctgtgcctcaccctgttcgtggaggagtgcctgcgccggcgcgtcacccggaagcacatgatcctcgtggtggtcacgaccctgtgcgccatcatcctgggcgggctcacctggatggacctgctgcgcgcgctcatcatgctgggcgacaccatgagcggccggatggggggccagatccacctggccatcatggccgtgttcaagatgtcccccgggtacgtgctcggcatcttcctgcgcaagctgacgagccgggagaccgccctcatggtcatcgggatggccatgaccaccgtgctgtccatcccgcacgacctgatggagttcatcgacggcatcagcctcggcctgatcctgctcaagatggtgacgcacttcgacaacacccaggtcgggaccctggcgctggccctcaccttcatcaagtccacgatgcccctggtgatggcctggcgcaccatcatggccgtgctgttcgtcgtgaccctcatccccctgtgccggaccagctgcctgcagaagcagtcccactgggtggagatcacggccctcatcctgggcgcgcaggccctgcccgtctacctcatgaccctgatgaagggggccagcaagcgctcctggccgctgaacgagggcatcatggccgtggggctcgtgagcctgctgggctccgcgctcctgaagaacgacgtccccctggccggccccatggtggccgggggcctcctgctggccgcctacgtgatgagcgggtccagcgcggacctctccctggagaaggccgccaacgtccagtgggacgagatggccgacatcaccggcagcagccccatcatcgaggtgaagcaggacgaggacgggtccttcagcatccgggacgtggaggagaccaacatgatcacgctgctcgtcaagctggccctgatcaccgtgtccggcctctacccgctggcgatccccgtgaccatgaccctgtggtacatgtggcaggtcaagacgcagcgcagcggcgccctctgggacgtgccctcccccgccgccgcccagaaggcgaccctgaccgagggggtgtaccggatcatgcagcgcggcctgttcgggaagacccaggtcggcgtggggatccacaccgagggcgtgttccacacgatgtggcacgtcacccggggcagcgtgatctgccacgagtccgggcgcctcgagccgagctgggccgacgtgcggaacgacatgatctcctacggcgggggctggcgcctgggcgacaagtgggacaaggaggaggacgtccaggtgctggccatcgagcccgggaagaaccccaagcacgtgcagaccaagcccggcctcttcaagaccctgacgggggagatcggcgccgtcaccctggacttcaagccggggaccagcggctcccccatcatcaaccggaagggcaaggtgatcgggctctacggcaacggggtggtcaccaagagcggcgactacgtgtccgccatcacgcaggcggagcgcatcggggagcccgactacgaggtggacgaggacatcttccgcaagaagcggctgaccatcatggacctgcacccgggcgccggcaagaccaagcgcatcctgcccagcatcgtccgggaggccctcaagcgccggctgcgcaccctgatcctcgcccccacgcgggtggtggcggccgagatggaggaggccctgcgcgggctgcccatccggtaccagaccccggccgtcaagtccgagcacaccggccgcgagatcgtggacctcatgtgccacgccaccttcacgacccggctgctgagctccacccgcgtgcccaactacaacctcatcgtcatggacgaggcgcacttcaccgaccccagctccgtggccgcccgggggtacatcagcacgcgcgtcgagatgggcgaggccgccgcggtgttcatgaccgccacccccccggggaccacggaccccttcccccagagcaactcccccatcgaggacatcgagcgggagatcccggagcgcagctggaacaccggcttcgactggatcaccgactaccagggcaagaccgtgtggttcgtcccctccatcaaggccgggaacgacatcgccaactgcctgcggaagagcggcaagaaggtgatccagctgtcccgcaagacgttcgacaccgagtaccccaagaccaagctcaccgactgggacttcgtgatcacgaccgacatcagcgagatgggggccaacttccgggcgggccgcgtcatcgacccccgccggtgcctgaagccggtgatcctgaccgacgggcccgagcgcgtgatcctcgccggccccatccccgtcaccccggcctccgccgcgcagcggcgcggccggatcgggcgcaaccccgcccaggaggacgaccagtacgtgttcagcggcgaccccctgcggaacgacgaggaccacgcccactggacggaggccaagatgctgctcgacaacatctacacccccgaggggatcatcccgaccctgttcggccccgagcgcgagaagacccaggccatcgacggcgagttccggctgcgcggggagcagcggaagacgttcgtggagctcatgcgccggggcgacctgcccgtctggctgtcccacaaggtggcgagcgccgggatctcctacaaggaccgcgagtggtgcttcaccggcgagcggaacaaccagatcctcgaggagaacatcgaggtggagatctggacccgcgagggggagaagaagaagctgcggcccaagtggctggacgcccgcgtctacgccgacccgatggccctcaaggacttcaaggagttcgcgagcggccggaagtccatcaccctggacatcctgaccgagatcgccagcctccccacgtacctgtccagccgcgccaagctggccctcgacaacatcgtgatgctgcacaccaccgagcggggcgggaaggcctaccagcacgcgctgaacgagctccccgagtccctggagaccctgatgctcgtggccctgctgggcgccatgacggccgggatcttcctcttcttcatgcagggcaaggggatgggcaagctgagcatgggcctgatcgcgatcgccgtcgcctccgggctcctgtgggtggccgagatccagccgcagtggatcgccgcgagcatcatcctggagttcttcctcatggtgctgctggtccccgagcccgagaagcagcgcaccccccaggacaaccagctcatctacgtgatcctgaccatcctgaccatcatcgccctcgtggccgccaacgagatgggcctgatcgagaagacgaagaccgacttcgggttctaccaggtcaaggccgagaccaccatcctggacgtggacctccgcccggcgagcgcctggacgctgtacgccgtggccaccaccatcctgacccccatgctccggcacacgatcgagaacacctccgccaacctgagcctggcggccatcgccaaccaggccgccgtcctcatgggcctggggaagggctggcccctgcaccgcatggacctcggcgtgcccctgctggcgatggggtgctactcccaggtgaacccgaccaccctcacggccagcctggtcatgctgctcgtgcactacgccatcatcggccccgggctgcaggccaaggcgacccgggaggcccagaagcgcaccgccgccggcatcatgaagaaccccaccgtggacggcatcacggtcatcgacctggagcccatctcctacgacccgaagttcgagaagcagctcgggcaggtgatgctgctggtgctctgcgtcggccagctgctgctcatgcggaccacctgggccttctgcgaggtgctgaccctggcgacggggcccatcctcaccctgtgggagggcaaccccgggcgcttctggaacaccaccatcgccgtgagcacggccaacatcttccggggctcctacctggccggcgccgggctcgcgttcagcctgatcaagaacgcccagaccccccgccggggcaccgggaccatgggcgagacgctgggggagaagtggaagcgccagctcaactccctggaccggaaggagttcgaggagtacaagcgcagcggcatcctggaggtcgaccggaccgaggcccgctccgccctcaaggacggcagcaagatcaagtacgccgtgtcccgggggaccagcaagatccgctggatcgtggagcggggcatggtcaagccgaaggggaaggtggtggacctgggctgcgggcgcggcggctggtcctactacatggcgaccctgaagaacgtcaccgaggtgaaggggtacacgaagggcgggcccggccacgaggagcccatccccatggccacctacgggtggaacctcgtgaagctgcacagcggcgtcgacgtgttctacaagccgaccgagcaggtggacaccctgctctgcgacatcggcgagtccagctccaaccccacgatcgaggaggggcggaccctgcgcgtcctgaagatggtggagccctggctgagcagcaagcccgagttctgcatcaaggtcctcaacccgtacatgcccaccgtgatcgaggagctggagaagctgcagcgccggcacggcgggtccctcgtgcgctgccccctgagccggaactccacccacgagatgtactgggtcagcggcgtgtccggcaacatcgtgagctccgtcaacacgaccagcaagatgctgctcaaccgcttcaccacccggcaccgcaagcccacgtacgagaaggacgccgacctgggggccggcacccggtccgtgagcaccgagaccgagaagccggacatgacgatcatcgggcgccggctgcagcgcctccaggaggagcacaaggagacctggcactacgaccacgagaacccctaccggacctgggcgtaccacggctcctacgaggcccccagcaccgggtccgccagctccatggtgaacggcgtcgtgaagctgctgacgaagccgtgggacgtggtccccatggtgacccagctcgccatgaccgacaccacgcccttcggccagcagcgcgtgttcaaggagaaggtcgacacccggaccccccagccgaagcccgggacccaggtggtgatgacgaccaccgccaactggctgtggaccctgctcggccgcaagaagaacccccggctgtgcacgcgcgaggagttcatcagcaaggtccggtccaacgcggccatcggggccgtgttccaggaggagcagggctggaccagcgcctccgaggccgtgaacgacagccgcttctgggagctggtcgacaaggagcgggcgctccaccaggaggggaagtgcgagagctgcgtgtacaacatgatgggcaagcgcgagaagaagctgggcgagttcgggcgggccaagggctcccgcgccatctggtacatgtggctgggggcccgcttcctcgagttcgaggccctgggcttcctgaacgaggaccactggttcgggcgggagaacagctggtccggcgtggagggcgaggggctccaccgcctgggctacatcctggaggacatcgacaagaaggacggggacctcatctacgcggacgacaccgccggctgggacacccggatcacggaggacgacctgctgaacgaggagctcatcaccgagcagatgaccccccaccacaagatcctggccaaggccatcttcaagctgacctaccagaacaaggtcgtgaaggtgctccgcccgacccccaagggcgcggtcatggacatcatcagccggaaggaccagcgcgggtccggccaggtggggacgtacggcctgaacaccttcaccaacatggaggtgcagctgatccggcagatggaggccgagggggtcatcacccgcgacgacatgcacaaccccaagggcctcaaggagcgggtggagaagtggctgaaggagtgcggcgtggaccgcctgaagcggatggccatcagcggggacgactgcgtcgtgaagcccctcgacgagcgcttctccacgagcctgctgttcctcaacgacatgggcaaggtgcggaaggacatcccgcagtgggagccctccaaggggtggaagaactggcaggaggtccccttctgcagccaccacttccacaagatcttcatgaaggacggccgctccctggtggtgccctgccggaaccaggacgagctgatcgggcgcgcccggatcagccagggcgccggctggtccctccgcgagaccgcgtgcctggggaaggcctacgcccagatgtggagcctgatgtacttccaccggcgcgacctccgcctggcctccatggccatctgcagcgcggtcccgaccgagtggttccccacctcccggacgacctggagcatccacgcccaccaccagtggatgaccaccgaggacatgctgaaggtgtggaaccgcgtgtggatcgaggacaaccccaacatgatcgacaagacgcccgtccacagctgggaggacatcccgtacctcggcaagcgggaggacctgtggtgcgggtccctgatcggcctcagctcccgcgccacctgggccaagaacatccacaccgccatcacccaggtgcggaacctgatcgggaaggaggagtacgtggactacatgcccgcgatgcgccggtacagcgcccacttcgagtccgagggcgtcctgtga

SEQ ID NO: 10540 - RNA, 9867 nt, synthetic construct
  misc_feature 1..9867: note = derived and/or modified CDS sequence (opt1) from DENV-4__KF907503__SS-prME
  source 1..9867: mol_type = other RNA
agcaccatcaccctgctctgcctgatccccaccgtgatggccttccacctgtccacccgcgacggcgagccgctcatgatcgtggccaagcacgagcgggggcgccccctgctgttcaagaccaccgagggcatcaacaagtgcaccctcatcgcgatggacctgggggagatgtgcgaggacaccgtgacctacaagtgccccctgctcgtgaacaccgagcccgaggacatcgactgctggtgcaacctgaccagcacctgggtgatgtacgggacctgcacccagtccggggagcggcgccgggagaagcgcagcgtggccctgaccccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcaccgtgttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcaccaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccatgatcacgccccggagcccctccgtggaggtcaagctgccggactacggcgagctgacgctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcaccttcaaggtgccgcacgccaagcggcaggacgtgacggtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacccagcacgggacgaccgtcgtgaaggtgaagtacgagggcgccggggccccctgcaaggtccccatcgagatccgggacgtgaacaaggagaaggtggtcggccgcatcatctccagcacgcccctggcggagaacaccaactccgtgacgaacatcgagctggagccgcccttcggggacagctacatcgtgatcggcgtcggcaactccgccctcaccctgcactggttccggaaggggagctccatcggcaagatgttcgagagcacctaccgcggggccaagcggatggccatcctgggcgagaccgcgtgggacttcgggtccgtgggcggcctcttcacgagcctggggaaggccgtgcaccaggtcttcggctccgtgtacaccaccatgttcgggggcgtgagctggatgatccgcatcctgatcgggttcctcgtcctgtggatcggcaccaactcccggaacacgagcatggccatgacctgcatcgccgtgggcgggatcaccctgttcctgggcttcaccgtgcaggccgacatggggtgcgtcgtgtcctggagcggcaaggagctcaagtgcgggagcggcatcttcgtggtcgacaacgtgcacacgtggaccgagcagtacaagttccagcccgagtcccccgcgcgcctggccagcgccatcctgaacgcccacaaggacggcgtgtgcgggatccggtccaccacccgcctcgagaacgtcatgtggaagcagatcacgaacgagctgaactacgtgctgtgggagggcgggcacgacctcaccgtggtcgccggcgacgtgaagggcgtgctgaccaaggggaagcgggcgctgaccccgcccgtcagcgacctcaagtactcctggaagacgtggggcaaggccaagatcttcacccccgaggcccgcaacagcaccttcctgatcgacgggcccgacacctccgagtgcccgaacgagcggcgcgcctggaacagcctggaggtggaggactacggcttcgggatgttcacgaccaacatctggatgaagttccgggagggctccagcgaggtgtgcgaccaccgcctcatgtccgccgcgatcaaggaccagaaggccgtccacgccgacatgggctactggatcgagagctccaagaaccagacctggcagatcgagaaggccagcctgatcgaggtgaagacctgcctgtggcccaagacgcacaccctctggtccaacggggtgctggagagccagatgctgatccccaagtcctacgcgggcccgttcagccagcacaactaccggcaggggtacgccacccagaccgtcggcccctggcacctcgggaagctggagatcgacttcggcgagtgccccggcaccacggtgaccatccaggaggactgcgaccaccgcgggcccagcctgcggacctccaccgccagcggcaagctcgtgacgcagtggtgctgccgctcctgcaccatgccgcccctgcgcttcctgggggaggacggctgctggtacgggatggagatccggcccctcagcgagaaggaggagaacatggtcaagtcccaggtgaccgccggccagggcaccagcgagacgttctccatggggctgctgtgcctcaccctgttcgtcgaggagtgcctgcgccggcgcgtgacccggaagcacatgatcctcgtggtcgtgatcaccctgtgcgccatcatcctgggcgggctcacgtggatggacctgctgcgcgcgctcatcatgctgggcgacaccatgagcggccggatcgggggccagatccacctggccatcatggccgtgttcaagatgtcccccgggtacgtcctcggcgtgttcctgcgcaagctgaccagccgggagaccgccctcatggtgatcgggatggccatgacgaccgtcctgtccatcccgcacgacctgatggagctcatcgacggcatcagcctgggcctgatcctcctgaagatcgtgacccagttcgacaacacccaggtggggacgctggcgctctccctgaccttcatccgcagcaccatgcccctgatcatggcctggcggaccatcatggccgtcctcttcgtggtgacgctgatccccctgtgccgcacctcctgcctccagaagcagagccactgggtcgagatcaccgccctgatcctgggcgcccaggcgctccccgtgtacctgatgaccctgatgaagggggcctcccggcgcagctggccgctcaacgagggcatcatggccgtggggctggtctccctgctcggcagcgccctgctgaagaacgacgtgcccctcgcgggccccatggtggccgggggcctgctgctcgccgcctacgtcatgagcgggtccagcgccgacctgtccctggagaaggcggccaacgtgcagtgggacgagatggccgacatcacgggcagctcccccatcatcgaggtgaagcaggacgaggacgggagcttctccatccgggacgtcgaggagaccaacatgatcaccctcctggtgaagctggccctcatcaccgtgagcggcctgtacccgctggccatccccgtcacgatgaccctctggtacatgtggcaggtcaagacccagcgctccggcgcgctgtgggacgtgcccagccccgccgccacccagaaggccgccctgtccgagggggtctaccggatcatgcagcgcggcctcttcgggaagacccaggtgggcgtggggatccacatggagggcgtcttccacaccatgtggcacgtgacccggggcagcgtgatctgccacgagaccgggcgcctggagccgtcctgggcggacgtccggaacgacatgatcagctacggcgggggctggcgcctgggcgacaagtgggacaaggaggaggacgtccaggtgctcgccatcgagcccgggaagaaccccaagcacgtccagaccaagcccggcctgttcaagacgctgaccggggagatcggcgccgtgaccctcgacttcaagccggggacctccggcagccccatcatcaaccgcaagggcaaggtgatcgggctgtacggcaacggggtcgtgacgaagtccggcgactacgtgagcgccatcacccaggccgagcggatcggggagcccgactacgaggtcgacgaggacatcttccgcaagaagcggctgaccatcatggacctccacccgggcgcgggcaagaccaagcgcatcctgccctccatcgtgcgggaggccctgaagcgccggctgcgcacgctcatcctggcccccacccgggtggtcgccgcggagatggaggaggccctgcgcgggctccccatccggtaccagaccccggccgtcaagagcgagcacaccggccgcgagatcgtggacctgatgtgccacgccacgagcaccacccggctgctctccagcacccgcgtccccaactacaacctgatcgtgatggacgaggcccacttcacggacccctccagcgtcgcggcccgggggtacatctccacccgcgtggagatgggcgaggccgccgccatcttcatgaccgcgacgcccccgggggccacggaccccttcccccagagcaactcccccatcgaggacatcgagcgggagatcccggagcgcagctggaacaccggcttcgactggatcaccgactaccagggcaagaccgtgtggttcgtcccctccatcaaggccgggaacgacatcgccaactgcctgcgcaagagcggcaagaaggtgatccagctctcccgcaagacgttcgacaccgagtaccccaagaccaagctgaccgactgggacttcgtggtcacgaccgacatcagcgagatgggggccaacttccgcgcgggccgggtgatcgacccccgccggtgcctgaagccggtgatcctcaccgacgggcccgagcgcgtcatcctggccggccccatccccgtgaccccggcctccgccgcgcagcggcgcggccggatcgggcgcaaccccgcccaggaggacgaccagtacgtgttcagcggcgaccccctgaagaacgacgaggaccacgcccactggacggaggccaagatgctcctggacaacatctacacccccgaggggatcatcccgaccctgttcggccccgagcgggagaagacccaggccatcgacggcgagttccgcctccgcggggagcagcgcaagacgttcgtcgagctgatgcggcgcggcgacctgcccgtgtggctctcctacaaggtggcgagcgccgggatctcctacaaggaccgggagtggtgcttcaccggcgagcgcaacaaccagatcctggaggagaacatggaggtcgagatctggacccgggagggggagaagaagaagctgcgcccccggtggctcgacgcccgcgtgtacgccgacccgatggccctgaaggacttcaaggagttcgcgagcggccggaagtccatcaccctggacatcctcacggagatcgccagcctgcccacctacctgagctcccgcgccaagctcgccctggacaacatcgtgatgctgcacaccaccgagcgcggcgggcgggcctaccagcacgcgctcaacgagctgcccgagagcctggagaccctcatgctggtcgccctgctcggcgccatgacggccgggatcttcctgttcttcatgcagggcaaggggatcggcaagctgtccatgggcctcatcatcatcgcggtggccagcgggctgctgtgggtggccgagatccagccgcagtggatcgccgcctccatcatcctcgagttcttcctgatggtcctgctcatccccgagcccgagaagcagcgcacgccccaggacaaccagctgatctacgtgatcctgaccatcctcaccatcatcggcctgatcgcggccaacgagatggggctgatcgagaagacgaagaccgacttcggcttctaccaggtgaagaccgagaccacgatcctcgacgtcgacctgcggccggccagcgcctggaccctgtacgccgtggcgaccaccatcctcacgcccatgctgcgccacaccatcgagaacacctccgccaacctgagcctcgccgccatcgccaaccaggcggccgtgctgatggggctgggcaagggctggcccctccaccggatggacctgggggtccccctgctcgccatgggctgctactcccaggtgaacccgaccacgctgaccgccagcctggtgatgctctccgtccactacgccatcatcgggcccggcctgcaggcgaaggccacccgcgaggcccagaagcggaccgccgcgggcatcatgaagaaccccacggtggacgggatcaccgtgatcgacctggagcccatcagctacgacccgaagttcgagaagcagctcggccaggtcatgctgctggtgctctgcgccgggcagctgctgctcatgcgcaccacctgggccttctgcgaggtgctgacgctggccaccggccccatcctcaccctgtgggaggggaaccccggccggttctggaacaccacgatcgccgtctccaccgcgaacatcttccgcggcagctacctggccggggccggcctcgccttctccctgatcaagaacgcccagacgccccggcgcgggaccggcacgaccggggagaccctgggcgagaagtggaagcggcagctcaacagcctggaccgcaaggagttcgaggagtacaagcggtccggcatcctggaggtggaccgcaccgaggccaagagcgccctcaaggacgggtccaagatcaagcacgccgtgagccggggcagctccaagatccgctggatcgtcgagcgggggatggtgaagccgaagggcaaggtggtcgacctggggtgcggccgcggcgggtggagctactacatggccacgctgaagaacgtgaccgaggtgaagggctacaccaagggcggccccgggcacgaggagcccatccccatggccacctacggctggaacctcgtcaagctgcactccggcgtggacgtgttctacaagccgaccgagcaggtcgacacgctgctctgcgacatcggggagagctccagcaaccccaccatcgaggagggccgcaccctgcgggtgctgaagatggtggagccctggctctccagcaagcccgagttctgcatcaaggtcctgaacccgtacatgcccaccgtgatcgaggagctggagaagctgcagcgcaagcacgggggcaacctcgtccggtgccccctgtcccgcaacagcacgcacgagatgtactgggtgtccggcgcgagcgggaacatcgtgtccagcgtcaacaccacctccaagatgctgctcaaccggttcaccacgcgccaccggaagcccacctacgagaaggacgtggacctgggcgccgggacccgcagcgtgtccaccgagacggagaagccggacatgaccatcatcggccggcgcctgcagcggctccaggaggagcacaaggagacctggcactacgaccaggagaacccctaccgcacctgggcctaccacgggagctacgaggccccctccacgggcagcgcgagctccatggtcaacggcgtggtgaagctgctgaccaagccgtgggacgtcatccccatggtgacccagctcgccatgaccgacacgacccccttcgggcagcagcgggtgttcaaggagaaggtcgacacccgcacgccccagccgaagcccggcacgcggatggtgatgaccaccaccgccaactggctgtgggccctgctcgggaagaagaagaacccccgcctgtgcacgcgggaggagttcatcagcaaggtgcgctccaacgccgcgatcggcgccgtcttccaggaggagcaggggtggaccagcgcctccgaggccgtgaacgacagccggttctgggagctggtggacaaggagcgcgccctccaccaggagggcaagtgcgagtcctgcgtctacaacatgatgggcaagcgggagaagaagctgggggagttcggccgcgcgaaggggagccgcgccatctggtacatgtggctgggcgcccggttcctcgagttcgaggccctggggttcctgaacgaggaccactggttcggccgcgagaactcctggagcggcgtggagggggagggcctccaccggctggggtacatcctggaggagatcgacaagaaggacggcgacctcatgtacgccgacgacaccgcgggctgggacacccgcatcacggaggacgacctgcagaacgaggagctgatcaccgagcagatggcgccccaccacaagatcctcgccaaggccatcttcaagctgacctaccagaacaaggtggtcaaggtgctgcggccgacgccccgcggggcggtgatggacatcatctcccggaaggaccagcggggcagcgggcaggtcggcacgtacgggctcaacaccttcaccaacatggaggtgcagctgatccggcagatggaggccgagggcgtgatcacccaggacgacatgcagaaccccaagggcctgaaggagcgcgtcgagaagtggctcaaggagtgcggggtggaccggctgaagcgcatggccatctccggcgacgactgcgtggtcaagcccctggacgagcggttcgggaccagcctcctgttcctgaacgacatgggcaaggtgcgcaaggacatcccgcagtgggagccctccaaggggtggaagaactggcaggaggtgcccttctgcagccaccacttccacaagatcttcatgaaggacggccggtccctcgtcgtgccctgccgcaaccaggacgagctgatcggccgggcccgcatcagccagggggccggctggagcctgcgggagacggcgtgcctcgggaaggcctacgcccagatgtggtccctgatgtacttccaccgccgcgacctgcggctcgccagcatggccatctgctccgcggtgccgaccgagtggttccccaccagccgcaccacgtggtccatccacgcccaccaccagtggatgaccaccgaggacatgctgaaggtctggaaccgggtgtggatcgaggacaaccccaacatgaccgacaagacgcccgtgcacagctgggaggacatcccgtacctgggcaagcgcgaggacctctggtgcgggtccctgatcggcctgagctcccgggccacctgggccaagaacatccacaccgccatcacccaggtccgcaacctcatcggcaaggaggagtacgtggactacatgcccgtgatgaagcggtacagcgcgccctccgagagcgagggggtcctgtga

SEQ ID NO: 10541 - RNA, 9867 nt, synthetic construct
  misc_feature 1..9867: note = derived and/or modified CDS sequence (opt1) from DENV-4__AY947539__SS-prME
  source 1..9867: mol_type = other RNA
agcaccatgaccctgctctgcctgatccccaccgccatggccttccacctgtccacccgcgacggcgagcccctcatgatcgtggcccggcacgagcgcgggcggcccctgctgttcaagaccaccgagggcatcaacaagtgcacgctcatcgccatggacctgggggagatgtgcgaggacaccgtcacctacgagtgccccctgctcgtgaacaccgagcccgaggacatcgactgctggtgcaacctgacgagcgcctgggtgatgtacgggacctgcacccagtccggggagcgccggcgcgagaagcggagcgtcgccctgacgccccactccggcatgggcctcgagacccgcgccgagacctggatgagctccgagggggcgtggaagcacgcccagcgggtggagagctggatcctgcgcaaccccggcttcgccctgctcgccgggttcatggcgtacatgatcggccagaccgggatccagcggaccgtgttcttcgtcctgatgatgctggtggccccctcctacggcatgcgctgcgtgggcgtcgggaaccgggacttcgtggagggcgtgagcgggggcgcctgggtcgacctcgtgctggagcacggcgggtgcgtgacgaccatggcccagggcaagcccaccctggacttcgagctcatcaagaccacggccaaggaggtcgcgctgctgcgcacctactgcatcgaggcctccatcagcaacatcaccaccgccacgcggtgcccgacccagggggagccctacctcaaggaggagcaggaccagcagtacatctgccgccgggacgtggtggaccgcggctgggggaacggctgcggcctgttcgggaagggcggggtcgtgacctgcgccaagttctcctgcagcggcaagatcaccgggaacctggtgcagatcgagaacctcgagtacacggtcgtggtgaccgtccacaacggcgacacccacgccgtgggcaacgacatccccaaccacggggtcaccgcgacgatcacgccccggtcccccagcgtggaggtgaagctgcccgactacggcgagctgaccctcgactgcgagccccgctccgggatcgacttcaacgagatgatcctgatgaagatgaagaagaagacctggctggtccacaagcagtggttcctcgacctgcccctgccgtgggccgccggcgccgacacgagcgaggtgcactggaactacaaggagcggatggtgaccttcaaggtcccccacgccaagcgccaggacgtgaccgtgctcgggtcccaggagggcgcgatgcacagcgccctgaccggcgccaccgaggtcgacagcggggacggcaaccacatgttcgccgggcacctgaagtgcaaggtgcgcatggagaagctccggatcaagggcatgtcctacacgatgtgcagcggcaagttctccatcgacaaggagatggccgagacccagcacgggaccaccgtggtcaaggtgaagtacgagggcgcgggggccccctgcaaggtgcccatcgagatccgcgacgtcaacaaggagaaggtggtgggccggatcatcagctccacgccgttcgccgagtacaccaacagcgtcaccaacatcgagctggagccgcccttcggggactcctacatcgtgatcggcgtgggcgacagcgccctgaccctccactggttccgcaaggggtccagcatcggcaagatgctggagtccacgtaccgcggggcgaagcggatggccatcctgggcgagaccgcctgggacttcgggagcgtcggcggcctcctgacctccctggggaaggccgtgcaccaggtgttcggcagcgtctacaccacgatgttcgggggcgtgtcctggatggtgcggatcctcatcgggttcctggtcctgtggatcggcaccaacagccgcaacacctccatggccatgacctgcatcgcggtgggcgggatcacgctgttcctcggcttcaccgtgcacgccgacaccgggtgcgccgtcagctggtccggcaaggagctgaagtgcgggagcggcatcttcgtgatcgacaacgtgcacacctggacggagcagtacaagttccagcccgagagcccggcccggctggcctccgcgatcctcaacgcccacgaggacggcgtctgcgggatccgcagcaccacccggctggagaacatcatgtggaagcagatcaccaacgagctgaactacgtgctctgggagggcgggcacgacctgacggtggtcgccggcgacgtgaagggcgtgctgtccaaggggaagcgcgccctcgcgccgcccgtcaacgacctgaagtacagctggaagacctggggcaaggcgaagatcttcacccccgaggccaagaactccaccttcctgatcgacgggccggacacgagcgagtgccccaacgagcggcgcgcctggaacttcctcgaggtggaggactacggcttcgggatgttcaccaccaacatctggatgaagttccgggagggctccagcgaggtgtgcgaccaccgcctgatgtccgccgcgatcaaggaccagaaggccgtccacgccgacatgggctactggatcgagagctccaagaaccagacctggcagatcgagaaggccagcctgatcgaggtgaagacgtgcctctggcccaagacccacaccctgtggtccaacggggtgctggagagccagatgctcatcccgaaggcctacgcgggccccttctcccagcacaactaccggcaggggtacgccacccagacggtcggcccctggcacctggggaagctggagatcgacttcggcgagtgccccggcaccaccgtgaccatccaggaggactgcgaccaccgcgggccgagcctccggaccacgaccgcctccggcaagctggtgacccagtggtgctgccgcagctgcaccatgccgcccctgcgcttcctcggggaggacggctgctggtacgggatggagatccggcccctgagcgagaaggaggagaacatggtcaagtcccaggtgagcgccggccagggcacgtccgagaccttcagcatggggctgctctgcctgaccctgttcgtggaggagtgcctccgccggcgcgtcacccggaagcacatgatcctggtggtcgtgacgaccctgtgcgccatcatcctcggcgggctgacctggatggacctgctccgcgcgctgatcatgctgggcgacaccatgtccggccggatgggcgggcagatccacctcgccatcatggccgtgttcaagatgagcccggggtacgtcctgggcatcttcctgcgcaagctcacgtcccgggagaccgccctgatggtgatcgggatggccatgaccaccgtgctgagcatcccccacgacctcatggagttcatcgacggcatctccctgggcctgatcctcctgaagatggtcacgcacttcgacaacacccaggtggggaccctggcgctcagcctgaccttcatccgctccacgatgcccctggtgatggcctggcggaccatcatggccgtcctcttcgtggtgaccctgatccccctgtgccgcaccagctgcctccagaagcagtcccactgggtcgagatcacggccctgatcctgggcgcgcaggccctcccggtgtacctgatgaccctgatgaagggggccagcaagcggtcctggcccctcaacgagggcatcatggccgtggggctggtcagcctgctcggctccgccctgctgaagaacgacgtgcccctcgcgggccccatggtggccgggggcctgctgctcgccgcctacgtcatgagcgggtccagcgccgacctgagcctggagaaggcggccaacgtgcagtgggacgagatggccgacatcaccggctccagcccgatcatcgaggtgaagcaggacgaggacgggtccttcagcatccgcgacatcgaggagaccaacatgatcacgctcctggtcaagctggccctcatcaccgtgtccggcctgtaccccctggccatccccgtgaccatgaccctctggtacatgtggcaggtcaagacgcagcggagcggcgcgctgtgggacgtgccctccccggccgccgcccagaaggccaccctgaccgagggggtgtaccgcatcatgcagcggggcctcttcgggaagacccaggtcggcgtggggatccacatggagggcgtgttccacacgatgtggcacgtcacccgcggcagcgtgatctgccacgagaccgggcggctggagccctcctgggcggacgtgcgcaacgacatgatcagctacggcgggggctggcggctgggcgacaagtgggacaaggaggaggacgtccaggtgctcgccatcgagcccgggaagaaccccaagcacgtgcagaccaagccgggcctgttcaagaccctgacgggggagatcggcgccgtcaccctcgacttcaagcccgggacctccggcagccccatcatcaaccgcaagggcaaggtgatcgggctgtacggcaacggggtggtcaccaagtccggcgactacgtgagcgccatcacgcaggcggagcgcaccggggagccggactacgaggtggacgaggacatcttccggaagaagcgcctgaccatcatggacctccaccccggcgccggcaagaccaagcggatcctgccctccatcgtccgcgaggccctgaagcggcgcctgcggacgctcatcctggcccccacccgcgtggtggccgcggagatggaggaggccctgcgggggctcccgatccgctaccagacccccgccgtcaagagcgagcacaccggccgggagatcgtggacctgatgtgccacgccacgttcaccacccgcctgctctccagcacccgggtgcccaactacaacctgatcgtcatggacgaggcccacttcacggacccctccagcgtggcggcccgcgggtacatcagcacccgggtggagatgggcgaggccgccgccatcttcatgaccgcgaccccgcccggggccacggaccccttcccccagtccaacagcccgatcgaggacatcgagcgcgagatccccgagcggtcctggaacaccggcttcgactggatcaccgactaccagggcaagaccgtctggttcgtgcccagcatcaaggccgggaacgacatcgccaactgcctgcgcaagtccggcaagaaggtcatccagctcagccggaagacgttcgacaccgagtaccccaagaccaagctgaccgactgggacttcgtggtgacgaccgacatctccgagatgggggcgaacttccgcgccggccgcgtcatcgacccgcggcgctgcctgaagcccgtgatcagcaccgacgggcccgagcgggtgatcctcgccggccccatcccggtcacccccgcctccgccgcgcagcgccggggccgcatcgggcggaaccccgcccaggaggacgaccagtacgtgttcagcggcgaccccctgaagaacgacgaggaccacgcccactggacggaggccaagatgctgctcgacaacatctacaccccggaggggatcatccccaccctgttcggccccgagcgcgagaagaaccaggccatcgacggcgagttccggctgcgcggggagcagcggaagaccttcgtggagctcatgcgccggggcgacctgcccgtctggctgtcctacaaggtggcgagcgccgggatctcctacaaggaccgcgagtggtgcttcacgggcgagcggaacaaccagatcctcgaggagaacatggaggtggagatctggacccgcgagggggagaagaagaagctgcggccgaagtggctggacgcccgcgtctacgccgaccccatggccctcaaggacttcaaggagttcgcgagcggccggaagtccatcaccctggacatcctgaccgagatcgccagcctccccacgtacctgtccagccgcgccaagctggccctcgacaacatcgtgatgctgcacaccaccgagcggggcgggaaggcgtaccagcacgccctgaacgagctcccggagtccctggagaccctgatgctcgtggccctgctgggcgccatgaccgccgggatcttcctcttcttcatgcagggcaaggggatcggcaagctgagcatgggcctgatcgcgatcgccgtcgccagcgggctcctgtgggtggccgagatccagccccagtggatcgccgcgtccatcatcctggagttcttcctcatggtgctgctgatccccgagcccgagaagcagcgcacgccgcaggacaaccagctcatctacgtcatcctgaccatcctgaccatcatcggcctcatcgccgccaacgagatggggctgatcgagaagaccaagacggacttcggcttctaccaggtgaagaccgagaccaccatcctggacgtggacctccgccccgccagcgcctggacgctgtacgcggtcgccaccaccatcctgacccccatgctccggcacacgatcgagaacacctccgccaacctgagcctggccgccatcgcgaaccaggccgccgtgctcatggggctgggcaagggctggcccctgcaccgcatggacctcggggtgccgctgctggccatgggctgctactcccaggtcaaccccaccaccctcatcgcgagcctggtgatgctgctcgtgcactacgccatcatcgggcccggcctgcaggccaaggccacgcgggaggcccagaagcgcaccgcggccggcatcatgaagaaccccaccgtcgacgggatcaccgtgatcgacctggagccgatctcctacgaccccaagttcgagaagcagctcggccaggtgatgctgctggtcctctgcgccgggcagctgctgctcatgcggacgacctgggccttctgcgaggtgctgaccctggccaccggccccgtgctcacgctgtgggaggggaaccccggccgcttctggaacaccaccatcgcggtcagcaccgccaacatcttccggggctcctacctggccggggccggcctcgccttcagcctgatcaagaacgcgcagacgccgcgccgggggaccggcaccaccggggagacgctgggcgagaagtggaagcgccagctcaactccctggaccggaaggagttcgaggagtacaagcgcagcggcatcctggaggtggaccggaccgaggccaagtccgccctcaaggacgggagcaagatcaagcacgccgtgtcccgcggcagctccaagatccggtggatcgtcgagcgcgggatggtgaagcccaagggcaaggtggtcgacctggggtgcggccggggcgggtggagctactacatggcgaccctgaagaacgtgaccgaggtgaagggctacacgaagggcgggcccgggcacgaggagcccatcccgatggccacctacggctggaacctcgtcaagctgcactccggcgtggacgtgttctacaagcccaccgagcaggtcgacaccctgctctgcgacatcggggagagcagctccaaccccaccatcgaggagggccgcacgctgcgggtgctgaagatggtggagccctggctcagctccaagccggagttctgcatcaaggtcctgaacccctacatgcccaccgtgatcgaggagctggagaagctgcagcgcaagcacgggggcagcctcgtgcgctgccccctgtcccggaacagcacccacgagatgtactgggtctccggcgtgagcgggaacatcgtctccagcgtgaacaccacgtccaagatgctgctcaaccgcttcaccacccggcaccgcaagccgacctacgagaaggacgtggacctgggcgccgggacgcggagcgtctccaccgagaccgagaagcccgacatgaccatcatcggccgccggctgcagcgcctccaggaggagcacaaggagacgtggcactacgaccaggagaacccctaccggacctgggcctaccacgggagctacgaggccccgtccaccggcagcgcgtccagcatggtgaacggcgtggtcaagctgctgaccaagccctgggacgtgatccccatggtgacgcagctcgccatgaccgacaccacccccttcgggcagcagcgcgtcttcaaggagaaggtggacacgcggaccccgcagcccaagcccggcacccgcatggtgatgaccacgaccgccaactggctgtgggccctgctcgggaagaagaagaacccccggctgtgcacccgcgaggagttcatctccaaggtccggagcaacgccgcgatcggcgccgtgttccaggaggagcaggggtggaccagcgcctccgaggccgtgaacgacagccgcttctgggagctggtcgacaaggagcgggccctccaccaggagggcaagtgcgagtcctgcgtgtacaacatgatgggcaagcgcgagaagaagctgggggagttcggccgggcgaaggggagccgcgccatctggtacatgtggctgggcgcccggttcctcgagttcgaggccctggggttcctgaacgaggaccactggttcggccgcgagaactcctggagcggcgtggagggggagggcctccaccgcctggggtacatcctggaggacatcgacaagaaggacggcgacctcatctacgcggacgacacggccggctgggacacccggatcaccgaggacgacctgctgaacgaggagctcatcaccgagcagatggccccgcaccacaagatcctggccaaggccatcttcaagctgacgtaccagaacaaggtcgtgaaggtgctccgccccacccccaagggggcggtcatggacatcatctcccggaaggaccagcgcggcagcggccaggtgggcacctacgggctgaacaccttcacgaacatggaggtgcagctgatccggcagatggaggccgagggcgtcatcacccaggacgacatgcacaaccccaagggcctcaaggagcgcgtggagaagtggctgaaggagtgcggggtggaccggctgaagcgcatggccatctccggcgacgactgcgtcgtgaagccgctcgacgagcggttcagcacctccctgctgttcctcaacgacatggggaaggtgcgcaaggacatcccccagtgggagcccagcaagggctggaagaactggcaggaggtccccttctgctcccaccacttccacaagatcttcatgaaggacgggcggagcctggtggtgccgtgccgcaaccaggacgagctgatcggccgggcccgcatctcccagggcgccgggtggagcctccgggagaccgcgtgcctgggcaaggcctacgcccagatgtggtccctgatgtacttccaccgccgggacctccgcctggccagcatggccatctgcagcgcggtccccaccgagtggttccccacgtcccggaccacctggagcatccacgcccaccaccagtggatgaccacggaggacatgctgaaggtgtggaaccgcgtgtggatcgaggacaaccccaacatgaccgacaagaccccggtccactcctgggaggacatcccctacctcgggaagcgcgaggacctgtggtgcggcagcctgatcgggctctccagccgggccacctgggccaagaacatccacacggccatcacccaggtgcgcaacctgatcggcaaggaggagtacgtggactacatgcccgtcatgaagcggtactccgcgcccttcgagagcgagggcgtgctgtga

SEQ ID NO: 10542 - RNA, 9879 nt, synthetic construct
  misc_feature 1..9879: note = derived and/or modified CDS sequence (opt2) from DENV-1__AB608789__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacatcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatgtccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccgtctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgagggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcgtcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggcccccgagtcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctcctcctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacgtcggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10543 - RNA, 9879 nt, synthetic construct
  misc_feature 1..9879: note = derived and/or modified CDS sequence (opt2) from DENV-1__AB608788__SS-prME
  source 1..9879: mol_type = other RNA
tccgtcaccatgctcctcatgctcctccccaccgtcctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgccaccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcgtcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctccaccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctacgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagacctccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccgccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggcgccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcagggcaccgcccaggtcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccaccgcctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgagaacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgactccgaccccgagggcgccctctggtga

SEQ ID NO: 10544 - RNA, 9879 nt, synthetic construct
  misc_feature 1..9879: note = derived and/or modified CDS sequence (opt2) from DENV-1__AB608786__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccctcgccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagggctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10545 - RNA, 9879 nt, synthetic construct
  misc_feature 1..9879: note = derived and/or modified CDS sequence (opt2) from DENV-1__AB608787__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcgtccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggatccgcaagatgctcatgaccggcaccctcggcgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagggctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgccccacctgggccaccaacatccaggtcgccatcaaccaggtccgccgcctcatcggcaacgagaactacctcgactacatgacctccatgaagcgcttcaagaacgagtccgagcccgagggcgccctctggtga

SEQ ID NO: 10546 - RNA, 9879 nt, synthetic construct
  misc_feature 1..9879: note = derived and/or modified CDS sequence (opt2) from DENV-1__HE795086__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcgtccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggacggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10547 - RNA, 9879 nt, synthetic construct
  misc_feature 1..9879: note = derived and/or modified CDS sequence (opt2) from DENV-1__AB189120__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggccgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagaccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgtcgtcttcctcctcctcaccctcggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtcaagaccaccctctccctccactacgcctggaagaccatggccatgatcctctccatcgtctccctcctccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccaaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagaaggccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccatcatgctcctcgccctcatcgccgtcctcaccggcggcgtcaccctcttcttcctctccggccgcggcctcggcaagacctccatcggcctcctctgcgtcatgtcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcaccgagcgcctccgccgcatggccatctccggcgacgactgcgtcgtcaagcccatcgacgaccgcttcgccaccgccctcaccgccctcaacgacatgggcaagatccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10548 - RNA, 9879 nt, synthetic construct
  misc_feature 1..9879: note = derived and/or modified CDS sequence (opt2) from DENV-1__AB189121__SS-prME
  source 1..9879: mol_type = other RNA
tccgtcaccatgctcttcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccatcatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcatccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaacatcaccttcatcatcgacggccccaacacctccgagtgccccgacaaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccgtctcccagcacaactaccgccccggctacttcacccagaccgccggcccctggcacctcggcaagctcgagctcgacttcgacctctgcgagggcaccaccgtcgtcgtcgacgagaactgcggcaaccgcggcccctccctccgcaccaccaccgtcaccggcaagaccatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacatgatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctgggccaccctcctctccctcaccttcgtcaagaccaccttctccctccactacgcctggaagaccatggccatgatcctctccatcgtctccctcctccccctctgcctctccaccacctcccagaagaccacctggctccccgtcctcctcggctccctcggctgcaagcccctcaccatgctcctcatcaccgagaacaagatctggggccgccgctcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggacgaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagcgcgacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccccaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagaagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcttcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10549 - RNA, 9879 nt, synthetic construct
  misc_feature 1..9879: note = derived and/or modified CDS sequence (opt2) from DENV-1__AB195673__SS-prME
  source 1..9879: mol_type = other RNA
tccgtcaccatgctcctcatgctcctccccaccgccctcaccttccacctcaccacccgcggcggcgagccccacatgatcgtcggcaagcaggagcgcggcaagtccctcctcttcaagacctccgccggcgtcaacatgtgcaccctcatcgccatggacctcggcgagctctgcgacgacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcgtcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagtccatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacaacatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgagatccaggacgacggcaccatgaagatcaaggacgaggagcgcgacgacaccatcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatgtcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcgtcgaggtcgaccgctccgaggccaaggagggcctcaagcgcggcgagaccatcaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccgccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatgggcgcccagctcatccgccagatggagtccgagggcatcttctccccctccgagctcgagacccccaacctcgccggccgcgtcctcgactggctcgagaagcacggcatcgagcgcctccgccgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10550 - RNA, 9879 nt, synthetic construct
  misc_feature 1..9879: note = derived and/or modified CDS sequence (opt2) from DENV-1__AB204803__SS-prME
  source 1..9879: mol_type = other RNA
tccgtcaccatgctcctcatgctcctccccaccgtcctcaccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgtcaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggccccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcatcaccgccaaccccatcgtcaccgacaaggagaagcccatcaacatcgaggccgagccccccttcggcgagtcctacatcgtcgtcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatgggcaagctcgtccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactcccgcgccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcagtgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcaccatgggccagctcacctggaacgacctcatccgcctctgcatcatggtcggcgccaacgcctccgacaagatgggcatgggcaccacctacctcgccctcatggccaccttccgcatgcgccccatgttcgccgtcggcctcctcttccgcggcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccaccctcctctccctcaccttcgtcaagaccaccttctccctccactacgcctggaagaccatggccatgaccctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccatcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaccgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatgtcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtccgcccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgctcccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10551 - RNA, 9879 nt, synthetic construct
  misc_feature 1..9879: note = derived and/or modified CDS sequence (opt2) from DENV-1__LC016760__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgctaccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatcgccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtgcgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgagatcatggagcccgagcacgcccagctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatgaaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10552 - RNA, 9879 nt, synthetic construct
  misc_feature 1..9879: note = derived and/or modified CDS sequence (opt2) from DENV-1__LC128301__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctcctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaaggtcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcacccgcgcctccttcatcgaggtcaagacctgcatctggcccaagtcccacaccctctggtccaacggcgtcctcgagtccgagatgatcatccccaagacctacggcggccccatctcccagcacaactaccgccccggctacttcacccagaccgccggcccctggcacctcggcaagctcgagctcgacttcggcctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttccgcatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagtcccaccagctctgggccgccctcctctccctcaccttcgtcaagaccaccttctccctccactacgcctggaagaccatggccatgatcctctccatcatctccctcttccccctctgcatgtccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagtcccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagaaggacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcaccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10553 - RNA, 9879 nt, synthetic construct
  misc_feature 1..9879: note = derived and/or modified CDS sequence (opt2) from DENV-1__LC011945__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgctaccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatcgccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggctccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccgtccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtgcgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgagatcatggagcccgagcacgcccagctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatgaaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10554 - RNA, 9879 nt, synthetic construct
  misc_feature 1..9879: note = derived and/or modified CDS sequence (opt2) from DENV-1__LC011949__SS-prME
  source 1..9879: mol_type = other RNA
tccgtcaccatgctcctcatgctcgtccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgacaccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10555 - RNA, 9879 nt, synthetic construct
  misc_feature 1..9879: note = derived and/or modified CDS sequence (opt2) from DENV-1__HM469966__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatgacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcgtcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatcctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctggaagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10556 - RNA, 9879 nt, synthetic construct
  misc_feature 1..9879: note = derived and/or modified CDS sequence (opt2) from DENV-1__JX669462__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccctcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10557 - RNA, 9879 nt, synthetic construct
  misc_feature 1..9879: note = derived and/or modified CDS sequence (opt2) from DENV-1__JX669463__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccctcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10558 - RNA, 9879 nt, synthetic construct
  misc_feature 1..9879: note = derived and/or modified CDS sequence (opt2) from DENV-1__JX669464__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgagatggactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagatccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10559 - RNA, 9879 nt, synthetic construct
  misc_feature 1..9879: note = derived and/or modified CDS sequence (opt2) from DENV-1__JX669465__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagacctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgagatggactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaagatccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10560 - RNA, 9879 nt, synthetic construct
  misc_feature 1..9879: note = derived and/or modified CDS sequence (opt2) from DENV-1__JX669466__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccatcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgacctcggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatcttcggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccgcctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10561 - RNA, 9879 nt, synthetic construct
  misc_feature 1..9879: note = derived and/or modified CDS sequence (opt2) from DENV-1__JX669467__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccaccgtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10562 - RNA, 9879 nt, synthetic construct
  misc_feature 1..9879: note = derived and/or modified CDS sequence (opt2) from DENV-1__HM469967__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgagatcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaactccgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcgtcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctggaagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctcaagtggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcaagaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagaaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10563 - RNA, 9879 nt, synthetic construct
  misc_feature 1..9879: note = derived and/or modified CDS sequence (opt2) from DENV-1__JX669468__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggcaacggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccaccgtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10564 - RNA, 9879 nt, synthetic construct
  misc_feature 1..9879: note = derived and/or modified CDS sequence (opt2) from DENV-1__JX669469__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcaaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatggcccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatcctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10565 - RNA, 9879 nt, synthetic construct
  misc_feature 1..9879: note = derived and/or modified CDS sequence (opt2) from DENV-1__JX669470__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgtcgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacctctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccgcaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10566 - RNA, 9879 nt, synthetic construct
  misc_feature 1..9879: note = derived and/or modified CDS sequence (opt2) from DENV-1__JX669471__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccctcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgtccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgaccgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10567 - RNA, 9879 nt, synthetic construct
  misc_feature 1..9879: note = derived and/or modified CDS sequence (opt2) from DENV-1__JX669472__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatgaagttcaccgtcgtcgtcggcaacgccaacggcatcctcgcccagggcaagaagatgatcaagccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccaccgtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10568 - RNA, 9879 nt, synthetic construct
  misc_feature 1..9879: note = derived and/or modified CDS sequence (opt2) from DENV-1__JX669473__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggccccctcctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatgaagttcaccgtcgtcgtcggcaacgccaacggcatcctcgcccagggcaagaagatgatcaagccccagcccatggagcacaagtactcctggaagtcctggggcaaggccaagatcatcggcgccgacatccagaacgccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccaccgtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10569 - RNA, 9879 nt, synthetic construct
  misc_feature 1..9879: note = derived and/or modified CDS sequence (opt2) from DENV-1__JX669474__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatgaagttcaccgtcgtcgtcggcaacgccaacggcatcctcgcccagggcaagaagatgatcaagccccagcccatggagcacaagtactcctggaagtcctggggcaaggccaagatcatcggcgccgacatccagaacgccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccacctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccaccgtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10570 - RNA, 9879 nt, synthetic construct
  misc_feature 1..9879: note = derived and/or modified CDS sequence (opt2) from DENV-1__JX669475__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccatctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctctccttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttcccctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10571 - RNA, 9879 nt, synthetic construct
  misc_feature 1..9879: note = derived and/or modified CDS sequence (opt2) from DENV-1__JX669461__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgagatggactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccctcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10572 - RNA, 9879 nt, synthetic construct
  misc_feature 1..9879: note = derived and/or modified CDS sequence (opt2) from DENV-1__KF184975__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccgaggaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccatccaggacgagaagggcgtcatccagaacggccgcctcatcaccgccaaccccatcgtcaccgacaaggagaagcccgtcaacatcgagaccgagccccccttcggcgagtcctacatcgtcgtcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcaacggcatcctcgcccagggcaagaagatggtccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgacaacttctccctcggcctcctctgcgtctccatcatggtcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcgtcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgcctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggccgagaaggccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcgtcgagccctcctgggcctccgtcaagaaggacctcatctcctacggcggcggctggcgcttccagggcctctggaacaccggcgaggaggtccaggtcatcgccgtcgagcccggcaagaacccccgcaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagaccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggccgcctcccccagcacctcaccctcaaggcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgccgaggaccaccagcacgccaccatgctcgacgtcgacctccgccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcaccgaggtcgaccgctccgaggccaaggagggcctcaagcgcggcgagaccaccaagcacgccgtctcccgcggcgccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10573 - RNA, 9879 nt, synthetic construct
  misc_feature 1..9879: note = derived and/or modified CDS sequence (opt2) from DENV-1__KT831765__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgctaccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcatgctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgtcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccatcaacatgacctcccgcatgctcctcaaccgcttcaccatggcccaccgcaagcccacctacgagcgcgacgtcgacctcggcgccggcacccgccacgtcaccgtcgagcccgaggtcgccaacctcgacatcatcggccagcgcatcgagaacatcaagtgcgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatctccggcggcaacatgtacgccgacgacaccgccggctgggacacccgcatcaccgaggacgacctccagaacgaggccaagatcaccgagatcatggagcccgagcacgcccagctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10574 - RNA, 9879 nt, synthetic construct
  misc_feature 1..9879: note = derived and/or modified CDS sequence (opt2) from DENV-1__KP188567__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatcaagccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgccctcgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctcccctcctccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggcaccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgccgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10575 - RNA, 9879 nt, synthetic construct
  misc_feature 1..9879: note = derived and/or modified CDS sequence (opt2) from DENV-1__KP188568__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgagatggactccttctccctcggcatcctctgcgtctccatcctcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctcccctccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgccatccaggacgaggagcgcgacatccccgagcgctcctggaacaccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctgggtcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccgtcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10576 - RNA, 9879 nt, synthetic construct
  misc_feature 1..9879: note = derived and/or modified CDS sequence (opt2) from DENV-1__KF971870__SS-prME
  source 1..9879: mol_type = other RNA
tccgtcaccatgctcctcatgctcatgcccaccgccctcgccttccacctcaccacccgcggcggcgagccccacatgatggtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtcctccgccatcaaggactccaaggccgtccacgccgacatgggctactggatcgagtccgagaagaacgacacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgatcggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtcttccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcgagaagctccgcccccgctggctcggcgcccgcacctactccgaccccctcgccctccgcgacttcaaggagttcgccgccggccgccgctccgtctccggcgacctcatcctcgagatcggcaagctcccccagcacctcacccagcgcgcccagaacgccctcgacaacctcgtcatgctccacaactcccagcagggcggccgcgcctacacccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccgcctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctccaactgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10577 - RNA, 9879 nt, synthetic construct
  misc_feature 1..9879: note = derived and/or modified CDS sequence (opt2) from DENV-1__KF971871__SS-prME
  source 1..9879: mol_type = other RNA
tccgtcaccatgctcctcatgctcatgcccaccgccctcgccttccacctcaccacccgcggcggcgagccccacatgatggtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgacacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgatcggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtcttccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcggcgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccgcctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctccaactgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10578 - RNA, 9879 nt, synthetic construct
  misc_feature 1..9879: note = derived and/or modified CDS sequence (opt2) from DENV-1__KF971869__SS-prME
  source 1..9879: mol_type = other RNA
tccgtcaccatgctcctcatgctcatgcccaccgccctcgccttccacctcaccacccgcggcggcgagccccacatgatggtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgacacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgatcggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtcttccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccgcctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctccaactgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10579 - RNA, 9879 nt, synthetic construct
  misc_feature 1..9879: note = derived and/or modified CDS sequence (opt2) from DENV-1__JN903578__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaaggtcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcatccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcccgcttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcaccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgagatcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacgtctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatcaccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagaaggacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacggcgaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggctcccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgaccaccatgaagcgcttcaagaacgagtccgaccccgagggcgccctctggtga

SEQ ID NO: 10580 - RNA, 9879 nt, synthetic construct
  misc_feature 1..9879: note = derived and/or modified CDS sequence (opt2) from DENV-1__JN903579__SS-prME
  source 1..9879: mol_type = other RNA
tccgtcaccatgctcctcatgctcctccccaccgccctcgccttccacctcaccacccgcggcggcgagccccacatgatcgtcggcaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgacaccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatcgccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccatcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggctccctcttcatgatcctcaccgtcgccgccaacgagatgggcctcctcgagaccaccaagaaggacctcggcatcggccacgtcgtcgccgagaaccaccaccacgccaccaccctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctctacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacaccacctccatgaagcgcttcaagaacgagtccgaccccgagggcgccctctggtga

SEQ ID NO: 10581 - RNA, 9879 nt, synthetic construct
  misc_feature 1..9879: note = derived and/or modified CDS sequence (opt2) from DENV-1__JN903580__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgcaacacctccctctccatgacctgcatcgccgtcggcatggtcaccctctacctcggcgtcatggtccaggccgacaccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgaagtcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatcgccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccgcaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcgacaccggcgcccagggcgagaccctcggcgagaagtggaagcgccagctcaaccagctctccaagcccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatggagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctctacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgaccccgagggcgccctctggtga

SEQ ID NO: 10582 - RNA, 9879 nt, synthetic construct
  misc_feature 1..9879: note = derived and/or modified CDS sequence (opt2) from DENV-1__JN903581__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgcaacacctccctctccatgacctgcatcgccgtcggcatggtcaccctctacctcggcgtcatggtccaggccgacaccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgtcatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggaggaggaggagaacctcgtccgctccatggtctccgccggctccggcgaggtcgactccttctccctcggcctcctctgcgtctccatcatgatcgaggaggtcatgaagtcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatgctcaagctcctcgccgacttccagtcccaccagctctggaccaccctcctctccctcaccttcatcaagaccaccctctccctcgactacgcctggaagaccatcgccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcgacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcgagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgtcaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctctacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgaccccgagggcgccctctggtga

SEQ ID NO: 10583 - RNA, 9879 nt, synthetic construct
  misc_feature 1..9879: note = derived and/or modified CDS sequence (opt2) from DENV-1__KX380796__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatgcagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagaccgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttcaacggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10584 - RNA, 9879 nt, synthetic construct
  misc_feature 1..9879: note = derived and/or modified CDS sequence (opt2) from DENV-1__KX380799__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggccgcttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10585 - RNA, 9879 nt, synthetic construct
  misc_feature 1..9879: note = derived and/or modified CDS sequence (opt2) from DENV-1__KX380800__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccatcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10586 - RNA, 9879 nt, synthetic construct
  misc_feature 1..9879: note = derived and/or modified CDS sequence (opt2) from DENV-1__KX380802__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatgggcaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10587 - RNA, 9879 nt, synthetic construct
  misc_feature 1..9879: note = derived and/or modified CDS sequence (opt2) from DENV-1__KX380797__SS-prME
  source 1..9879: mol_type = other RNA
tccgtcaccgtcctcctcatgctcctccccaccgccctcgccttccacctcaccacccgcggcggcgagccccacatgatcgtctccaagcaggagcgcggcaagtccctcctcttcaagacctccaccggcgtcaacatgtgcaccctcatcgccatggacctcggcgagctctgcgaggacaccatgacctacaagtgcccccgcatcaccgagaccgagcccgacgacgtcgactgctggtgcaacgccaccgagacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccctcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccttcacctcccaggacgagaagggcgtcacccagaacggccgcctcatcaccgccaaccccatcgtcaccgacaaggagaagcccgtcaacatcgaggccgagccccccttcggcgagtcctacctcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaaggtcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcacccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcggcctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttccgcatgcgccccatgttcgccgtcggcctcctcttccgccgcctcacctcccgcgaggtcctcctccgctccgtcggcctctccctcgtcgcctccgtcgagctccccaactccctcgaggagctcggcgacggcctcgccatgggcatcatgatgctcaagctcctcaccgacttccagtcccaccagctctgggccgccctcctctccctcaccttcgtcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggcaagtcccaggtcggcgtcggcgtcttccaggagggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcgtcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccatggaggccttcccccagtccaacgccgccatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcgtccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagtcccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctcaccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaaggtcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcatcgagcgcctcaagcgcatggccatctccggcgacgactgcgtcgtcaagcccgtcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10588 - RNA, 9879 nt, synthetic construct
  misc_feature 1..9879: note = derived and/or modified CDS sequence (opt2) from DENV-1__KX380805__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcgtctcctacgtcatgtgcaccggctccttcaagctcgagaaggaggtcgccgagacccagcacggcaccgtcctcgtccaggtcaagtacgagggcaccgacgccccctgcaagatccccatctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacacccagaacaccaccttcatcatcgacggccccgacacccccgagtgccccgacgaccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcctcctctccgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacatcgtcaagctccactccggccgcgacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgtcctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10589 - RNA, 9879 nt, synthetic construct
  misc_feature 1..9879: note = derived and/or modified CDS sequence (opt2) from DENV-1__KX380798__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10590 - RNA, 9879 nt, synthetic construct
  misc_feature 1..9879: note = derived and/or modified CDS sequence (opt2) from DENV-1__KJ649286__SS-prME
  source 1..9879: mol_type = other RNA
tccgtcaccatgctcctcatgctcctccccaccgtcctcgccttccacctcaccacccgcggcggcgagccccacatgatcgtcaccaagcaggagcgcggcaagtccctcctcttcaagacctccaccggcgtcaacatgtgcaccctcatcgccatggacctcggcgagctctgcgaggacaccatgacctacaagtgcccccgcatcaccgaggccgagcccgacgacatcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgccaccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgtcgagacccagcacggcaccgtcctcgtccaggtcaagtacgagggcaccgacgccccctgcaagatccccttcctcacccaggacgagaagggcgtcacccagaacggccgcgtcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctccaccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtctccggcatcctcgcccagggcaagaagatgatccgcccccagcccatggagcacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccgccctcctctccctcaccttcatcaagaccacctgctccctccactacgcctggaagaccatggccatggtcctctccatcgtctccctcttccccctctgcatgtccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcgtcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtacaagggcaagcgcctcgagcccacctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagtccgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccatgctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccatgaccctcaccgccgccgtcctcatgctcgtcgcccactacaccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatcgaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggcgccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccaggtcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccaccgcctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcctcttctccccctccgagctcgagacccccaacctcgccgagcgcgtcctcaactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgagaacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgcaagctcatcggcaacgagaactacctcgactacatgacctccatgaagcgcttcaagaacgactccgaccccgagggcgccctctggtga

SEQ ID NO: 10591 - RNA, 9879 nt, synthetic construct
  misc_feature 1..9879: note = derived and/or modified CDS sequence (opt2) from DENV-1__KF887994__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgctcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcatggcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggtactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccacaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccttctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcgtctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgcctggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgcaagctcatcggcaacgagaactacctcgactacatgacctccatgaagcgcttcaagaacgagtccgaccccgagggcgccctctggtga

SEQ ID NO: 10592 - RNA, 9879 nt, synthetic construct
  misc_feature 1..9879: note = derived and/or modified CDS sequence (opt2) from DENV-1__JQ675358__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccagatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagcgctcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacaaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagacctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgcctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccctcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcacctcccacaacatcctcgtcgaggtccaggacgacggcaccatgaagatcaaggacgaggagcgcgacgacaccctcaccatcctcgtcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagccccgcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccgtcggcggcggccgccgcggcatgggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctccacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10593 - RNA, 9879 nt, synthetic construct
  misc_feature 1..9879: note = derived and/or modified CDS sequence (opt2) from DENV-1__FJ850070__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgcctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagtcctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10594 - RNA, 9879 nt, synthetic construct
  misc_feature 1..9879: note = derived and/or modified CDS sequence (opt2) from DENV-1__FJ850071__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgcaagctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10595 - RNA, 9879 nt, synthetic construct
  misc_feature 1..9879: note = derived and/or modified CDS sequence (opt2) from DENV-1__FJ850073__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatcaagttcaccgtcgtcgtcggcaacgccgacggcatcctcgcccagggcaagaagatgatccgcccccagcccatggagcacaagtactcctggaagtcctggggcaaggccaagatcatcggcgccgacatccagaacaccaccttcatcatcgacggccccgacaccctcgagtgccccgacgagcagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatgtacggcggccccgtctcccagcacaactaccgccccggctacttcacccagaccgccggcccctggcacctcggcaagctcgagctcgacttcgacctctgcgagggcaccaccgtcgtcgtcgacgagcactgcggctcccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcgtcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgacaagatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcatcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacgagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggtcgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatggccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacctcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccgcaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcttctcctccgagctcgagtcccccaacctcgccgagcgcgtcctcgactggctcgagaagcacggcgccgagcgcctcaagcgcatggccatctccggcgacgactgcgtcgtcaagcccatcgacgaccgcttcgccaccgccctcatcgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacggcaactacctcgactacatgacctccatgaagcgcttcaagaacgagtccgaccccgagggcgccctctggtga

SEQ ID NO: 10596 - RNA, 9879 nt, synthetic construct
  misc_feature 1..9879: note = derived and/or modified CDS sequence (opt2) from DENV-1__FJ850075__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagaccatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10597 - RNA, 9879 nt, synthetic construct
  misc_feature 1..9879: note = derived and/or modified CDS sequence (opt2) from DENV-1__FJ850077__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcaggtccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgcaagctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaaccgcatctggggccgcaagtcctggcccatcaacgagggcgtcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccaccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgacatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10598 - RNA, 9879 nt, synthetic construct
  misc_feature 1..9879: note = derived and/or modified CDS sequence (opt2) from DENV-1__FJ850081__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgccgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10599 - RNA, 9879 nt, synthetic construct
  misc_feature 1..9879: note = derived and/or modified CDS sequence (opt2) from DENV-1__FJ850084__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcgccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccgccgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgcaagctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccaccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgacatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10600 - RNA, 9879 nt, synthetic construct
  misc_feature 1..9879: note = derived and/or modified CDS sequence (opt2) from DENV-1__FJ850087__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgtcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgtcgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcctccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10601 - RNA, 9879 nt, synthetic construct
  misc_feature 1..9879: note = derived and/or modified CDS sequence (opt2) from DENV-1__FJ850090__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcatccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgcaagctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccaccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctgggacttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgacatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10602 - RNA, 9879 nt, synthetic construct
  misc_feature 1..9879: note = derived and/or modified CDS sequence (opt2) from DENV-1__FJ850093__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacccacctcgccctcatggccaccttcaagatgcgccccatgttcgccgtcggcctcctcttccgccgcctcacctcccgcgaggtcctcctcctcaccatcggcctctccctcatggcctccatggagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatgatcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagaccaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagcgcgtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10603 - RNA, 9879 nt, synthetic construct
  misc_feature 1..9879: note = derived and/or modified CDS sequence (opt2) from DENV-1__GU131863__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacatcaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcccacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccgtcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcacctccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggccacccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggagggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagaagtccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagaaggtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10604 - RNA, 9879 nt, synthetic construct
  misc_feature 1..9879: note = derived and/or modified CDS sequence (opt2) from DENV-1__GQ868559__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggaggccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10605 - RNA, 9879 nt, synthetic construct
  misc_feature 1..9879: note = derived and/or modified CDS sequence (opt2) from DENV-1__GQ868560__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccatcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggaggccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacatcgactacatgacctccatgaagcgcttcaagaacgagtccgaccccgagggcgccctctggtga

SEQ ID NO: 10606 - RNA, 9879 nt, synthetic construct
  misc_feature 1..9879: note = derived and/or modified CDS sequence (opt2) from DENV-1__GQ868561__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctccccctcccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaccaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10607 - RNA, 9879 nt, synthetic construct
  misc_feature 1..9879: note = derived and/or modified CDS sequence (opt2) from DENV-1__GU131948__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgagatcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcatcttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccatctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacaccccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10608 - RNA, 9879 nt, synthetic construct
  misc_feature 1..9879: note = derived and/or modified CDS sequence (opt2) from DENV-1__GQ868562__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagcacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacccacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgccaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctcaagggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10609 - RNA, 9879 nt, synthetic construct
  misc_feature 1..9879: note = derived and/or modified CDS sequence (opt2) from DENV-1__GQ868563__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacgccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggcctctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgccgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtccccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10610 - RNA, 9879 nt, synthetic construct
  misc_feature 1..9879: note = derived and/or modified CDS sequence (opt2) from DENV-1__GQ868564__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaaggccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagcgcgaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcacgaggccgagcactccggcgcctcccacaacatcctcgtcgaggtccaggacgacggcaccatgaagatcaaggacgaggagcgcgacgacaccctcaccatcctcctcaaggccgccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10611 - RNA, 9879 nt, synthetic construct
  misc_feature 1..9879: note = derived and/or modified CDS sequence (opt2) from DENV-1__GQ868565__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacgccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggcctctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgccgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10612 - RNA, 9879 nt, synthetic construct
  misc_feature 1..9879: note = derived and/or modified CDS sequence (opt2) from DENV-1__GQ868568__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggatcatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacacccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10613 - RNA, 9879 nt, synthetic construct
  misc_feature 1..9879: note = derived and/or modified CDS sequence (opt2) from DENV-1__GQ868569__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcgccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacgccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggcctctggaacatgggcgaggaggtccaggtcatcgccgtcgagcccggcaagaacccccgcaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgccgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10614 - RNA, 9879 nt, synthetic construct
  misc_feature 1..9879: note = derived and/or modified CDS sequence (opt2) from DENV-1__GQ868570__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaaggtcggcatcggcatcctcctcacctggctcggcctcaactcccgctccacctccctctccatgacctgcatcgccgtcggcatggtcaccctctacctcggcgtcatggtccaggccgacctcggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacacccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgacaagcagcgcaccccccaggacaaccagctcgcctacgtcgtcatcggcctcctcttcatgatcctcgccgtcgccgccaacgagatgggcctcctcgagaccaccaagaaggacctcggcatcggctacgtcgccaccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccgccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10615 - RNA, 9879 nt, synthetic construct
  misc_feature 1..9879: note = derived and/or modified CDS sequence (opt2) from DENV-1__KJ189302__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctccccctcccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10616 - RNA, 9879 nt, synthetic construct
  misc_feature 1..9879: note = derived and/or modified CDS sequence (opt2) from DENV-1__KJ189303__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacacccagaacaccaccttcatcatcgacggccccgacacccccgagtgccccgacggccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgagtgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10617 - RNA, 9879 nt, synthetic construct
  misc_feature 1..9879: note = derived and/or modified CDS sequence (opt2) from DENV-1__KR028435__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatctgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccatctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagggcggcatctccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctctactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcatcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10618 - RNA, 9879 nt, synthetic construct
  misc_feature 1..9879: note = derived and/or modified CDS sequence (opt2) from DENV-1__JQ922548__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagaaggtcgagacctgggccctccgccaccccggcttcaccgtcatcgccctcttcctcgcccacaccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggcccgcaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccatgtccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccaggccaagaagcaggaggtcgtcgtcctcggctcccaggagggcgccatgcacaccgccctcaccggcgccaccgagatccagacctccggcaccaccaccatgttcgccggccacctcaagtgccgcctcaagatggacaagctcaccctcaagggcgcctcctacgtcatgtgcaccggccccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgccttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcacccagggcaagaagatgatccgcccccagcccatggagcacaagtactcctggaagtcctggggcaaggccaagatcatcggcgccgacgcccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcacccgcgcctccttcatcgaggtcaagacctgcacctggccccgctcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaacggcggcgcctccctcggcaccaccaccgtcaccggcaagatcatccacgagtggtgctgccgctcctgcaccctcccccccctccgcttcctcggcgaggacggctgctggtacggcatggagatccgccccgtcaaggagaaggaggagaacctcttccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatcggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatcgccatggtcctctccatcgtctccctcttccccctctgcctctccaccacctcccagaagaccacctggctccccgtcctcctcggctccttcggctccaagcccctcaccatgttcctcatcaccgagaacaagatctggggccgcaagtcctggcccctcaacgagggcatcatggccgtcggcatcgtctccatcctcctctcctccctccccaagaacgacgtccccctcgccggccccctcatcgccggcggcatgctcatcgcctgctacgtcatctccggctcctccgccgacctctccctcgagcgcgccgccgaggtctcctgggaggaggaggccgagcactccggcgcctcccacaacatcctcgtcgaggtccaggacgacggcaacatgaagatcaaggacgaggagcgcgacgactccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgtccgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaacttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaactcccgcaccgaccgcgtcatcgacccccgccgctgcctcaagcccgtcatcctcaaggacggccccgagcgcgtcatcctcgccggccccatgcccgtcaccgccgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcaaggagctcctcatccccgacgccgacggccagcgcaccccccaggacaaccagctcgcctacgtcgtcatcggcctcctcttcatgatcctcaccgtcgccgccaacgagatgggcctcctcgagaccaccaagaagaacctcggcatcggccacgtcgtcgccgagaaccaccaccacgccaccatgctcgacatcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggccgccccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcctcatgaagaaccccaccgtcgacggcatcgccgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcgccaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagaacgagcacaagtccacctggcactacgacgaggacaacccctacaagacctgggcctaccacggcacctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgccccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagaactccaacctcgccgagcgcgccctcgactggctcgagaagcacggcgtcgagcgcctcaagcgcatggccatctccggcgacgactgcgtcgtcaagcccaccgacgaccgcttcgccaccgccctcaccgccctcaacgacatgggcaaggtccgcaaggacatcccccagtgcgagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggccgacgtcccctacctcggcaagcgcgaggaccagtggtgcggctccctcatcggcctcgccgcccgcgccacctgggccaccaacatccaggtcgccctcaaccaggtccgccgcctcatcggcaacgagaactacctcgactacatgacctccatgaagcgcttcaagaacgagtccgaccccgagggcgccctctggtga

SEQ ID NO: 10619 - RNA, 9879 nt, synthetic construct
  misc_feature 1..9879: note = derived and/or modified CDS sequence (opt2) from DENV-1__JQ922544__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctgcgagggcgcctggaagcagatccagaaggtcgagatctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgagttcgtcgagggcctctccggcgccacctgggtcgacgtcgtcctcgagcacggctcctgcctccacaccatggcccagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccacccacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggatcatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgaggagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtccgctccatggtctccgccggctccggcgaggtcgactccttctccctcggcctcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctggaccaccctcctctccctcaccttcatcaagaccaccctctccctcgactacgcctggaagaccatggccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatctccttcttcgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtcaacatgggccagcccctcaacaacgacgaggaccacgcccactggaccgaggccaagatgctcctcgacaacatcaacacccccgagggcatcatccccgccctcttcgagcccgagcgcaagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagcgcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccctcatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatgggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacaagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaacaaggtctggatcgaggagaacccctggatggaggacaagacccacgtctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga
